(12) United States Patent
Dietrich et al.

(10) Patent No.: US 12,385,060 B2
(45) Date of Patent: Aug. 12, 2025

(54) COMPOSITIONS AND METHODS FOR IMPROVING CROP YIELDS THROUGH TRAIT STACKING

(71) Applicant: Monsanto Technology LLC, St. Louis, MO (US)

(72) Inventors: Charles R. Dietrich, Chesterfield, MO (US); Natalia Ivleva, Webster Groves, MO (US); Thomas L. Slewinski, Chesterfield, MO (US)

(73) Assignee: Monsanto Technology LLC, St. Louis, MO (US)

(*) Notice: Subject to any disclaimer, the term of this patent is extended or adjusted under 35 U.S.C. 154(b) by 368 days.

(21) Appl. No.: 17/634,381

(22) PCT Filed: Aug. 13, 2020

(86) PCT No.: PCT/US2020/046130
§ 371 (c)(1),
(2) Date: Feb. 10, 2022

(87) PCT Pub. No.: WO2021/030560
PCT Pub. Date: Feb. 18, 2021

(65) Prior Publication Data
US 2022/0298527 A1 Sep. 22, 2022

Related U.S. Application Data

(60) Provisional application No. 62/886,890, filed on Aug. 14, 2019.

(51) Int. Cl.
*C12N 15/82* (2006.01)

(52) U.S. Cl.
CPC ..... *C12N 15/8297* (2013.01); *C12N 15/8218* (2013.01); *C12N 15/8262* (2013.01); *C12N 15/827* (2013.01)

(58) Field of Classification Search
None
See application file for complete search history.

(56) References Cited

U.S. PATENT DOCUMENTS

| | | | | |
|---|---|---|---|---|
| 2004/0111768 A1* | 6/2004 | da Costa e Silva | . | C07K 14/415 536/23.6 |
| 2005/0050590 A1* | 3/2005 | Danilevskaya | ...... | C12N 15/823 800/278 |
| 2008/0052792 A1* | 2/2008 | da Costa e Silva | . | C07K 14/415 536/23.6 |
| 2015/0282447 A1* | 10/2015 | Riechmann | .......... | C07K 14/415 800/290 |
| 2018/0051295 A1* | 2/2018 | Allen | ................. | C12N 15/8273 |
| 2018/0327771 A1* | 11/2018 | Creelman | .............. | C12N 15/00 |

OTHER PUBLICATIONS

Gutterson, Neal. "Anthocyanin biosynthetic genes and their application to flower color modification through sense suppression." HortScience 30.5 (1995): 964-966. (Year: 1995).*
Bruening, George. "Plant gene silencing regularized." Proceedings of the National Academy of Sciences 95.23 (1998): 13349- 13351. (Year: 1998).*
Elomaa, Paula, et al. "Transformation of antisense constructs of the chalcone synthase gene superfamily into Gerbera hybrida: differential effect on the expression of family members." Molecular Breeding 2 (1996): 41-50. (Year: 1996).*
Colliver, S. P., P. Morris, and M. P. Robbins*. "Differential modification of flavonoid and isoflavonoid biosynthesis with an antisense chalcone synthase construct in transgenic Lotus corniculatus." Plant Molecular Biology 35 (1997): 509-522. (Year: 1997).*
Emery, John F., et al. "Radial patterning of Arabidopsis shoots by class III HD-ZIP and KANADI genes." Current Biology 13.20 (2003): 1768-1774. (Year: 2003).*
Nunes, Aline CS, et al. "RNAi-mediated silencing of the myo-inositol-1-phosphate synthase gene (GmMIPS1) in transgenic soybean inhibited seed development and reduced phytate content." Planta 224 (2006): 125-132. (Year: 2006).*
Arziman, Zeynep, Thomas Horn, and Michael Boutros. "E-RNAi: a web application to design optimized RNAi constructs." Nucleic acids research 33.suppl_2 (2005): W582-W588. (Year: 2005).*
Bonawitz, Nicholas D., and Clint Chapple. "The genetics of lignin biosynthesis: connecting genotype to phenotype." Annual review of genetics 44 (2010): 337-363. (Year: 2010).*
Paul, Joseph W., and Yiping Qi. "CRISPR/Cas9 for plant genome editing: accomplishments, problems and prospects." Plant cell reports 35 (2016): 1417-1427. ( (Year: 2016).*
Doerks, Tobias, Amos Bairoch, and Peer Bork. "Protein annotation: detective work for function prediction." Trends in Genetics 14.6 (1998): 248-250 (Year: 1998).*

(Continued)

*Primary Examiner* — Amjad Abraham
*Assistant Examiner* — Kelsey L McWilliams
(74) *Attorney, Agent, or Firm* — MORRISON & FOERSTER LLP

(57) ABSTRACT

The present disclosure provides modified, transgenic, or genome edited/mutated corn plants that are semi-dwarf and have one or more improved ear traits and yield relative to a control plant, such as increased ear area, increased ear volume, increased single kernel weight, increased ear fresh weight, increased ear diameter, increased ear length, increased yield, increased kernels per ear, decreased ear tip void, and decreased ear void. The modified, transgenic, or genome edited/mutated corn plants comprise a transgene encoding one or more CONSTANS (CO) or CONSTANS-like (COL) polypeptides and a transgene encoding one or more MADS-box polypeptides, and can also have a reduced expression of one or more GA20 or GA3 oxidase genes. Also provided are methods for producing the modified, transgenic, or genome edited/mutated corn plants.

26 Claims, 21 Drawing Sheets
Specification includes a Sequence Listing.

(56) References Cited

OTHER PUBLICATIONS

Smith, Temple F., and Xiaolin Zhang. "The challenges of genome sequence annotation or "the devil is in the details"." Nature biotechnology 15.12 (1997): 1222-1223. (Year: 1997).*
Bork, Peer, and Amos Bairoch. "Go hunting in sequence databases but watch out for the traps." Trends in Genetics 12.10 (1996): 425-427. (Year: 1996).*
Petti, Carloalberto, et al. "Mapping of a cellulose-deficient mutant named dwarf1-1 in Sorghum bicolor to the green revolution gene gibberellin20-oxidase reveals a positive regulatory association between gibberellin and cellulose biosynthesis." Plant Physiology 169.1 (2015): 705-716. (Year: 2015).*
Wenkel, Stephan, et al. "CONSTANS and the CCAAT box binding complex share a functionally important domain and interact to regulate flowering of *Arabidopsis*." The Plant Cell 18.11 (2006): 2971-2984. (Year: 2006).*
Wells, James A. "Additivity of mutational effects in proteins." Biochemistry 29.37 (1990): 8509-8517. (Year: 1990).*
Ngo, J. Thomas, Joe Marks, and Martin Karplus. "Computational complexity, protein structure prediction, and the Levinthal paradox." The protein folding problem and tertiary structure prediction. Boston, MA: Birkhäuser Boston, 1994. 433-506. (Year: 1994).*
Guo, Haiwei H., Juno Choe, and Lawrence A. Loeb. "Protein tolerance to random amino acid change." Proceedings of the National Academy of Sciences 101.25 (2004): 9205-9210. (Year: 2004).*
Ng, Pauline C., and Steven Henikoff. "Predicting deleterious amino acid substitutions." Genome research 11.5 (2001): 863-874. (Year: 2001).*
Keskin, Ozlem, et al. "A new, structurally nonredundant, diverse data set of protein-protein interfaces and its implications." Protein Science 13.4 (2004): 1043-1055. (Year: 2004).*
Thornton, Janet M., et al. "From structure to function: approaches and limitations." nature structural biology 7.11 (2000): 991-994. (Year: 2000).*
Nishimura, Asuka, et al. "Over-expression of tobacco knotted 1-type class 1 homeobox genes alters various leaf morphology." Plant and Cell Physiology 41.5 (2000): 583-590. (Year: 2000).*
McConnell, Jane R., et al. "Role of PHABULOSA and PHAVOLUTA in determining radial patterning in shoots." Nature 411.6838 (2001): 709-713. (Year: 2001).*
International Search Report mailed on Jan. 27, 2021, for PCT Patent Application No. PCT/US2020/046130 filed on Aug. 13, 2020, seventeen pages.

\* cited by examiner

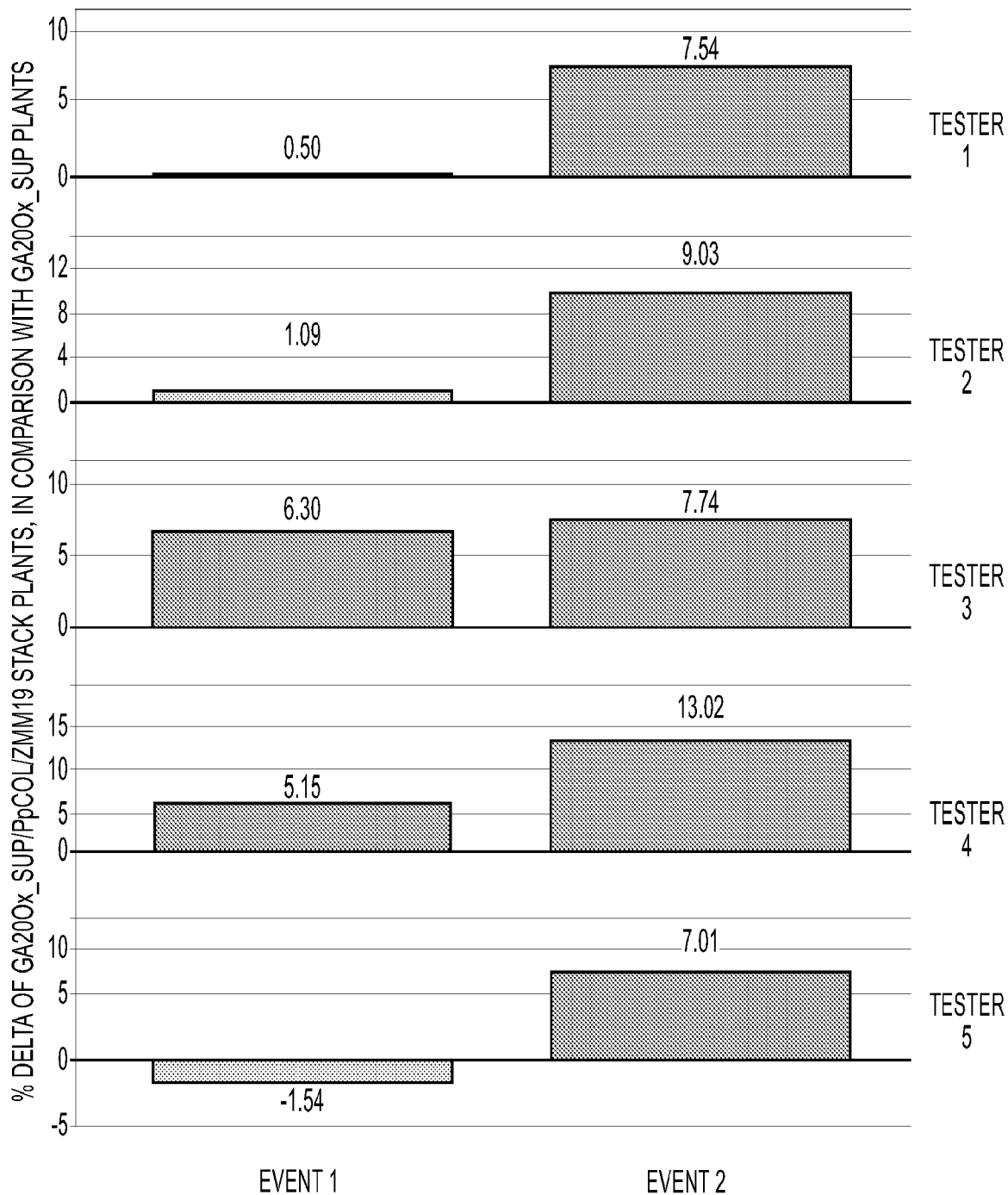
FIG. 4A-CONT

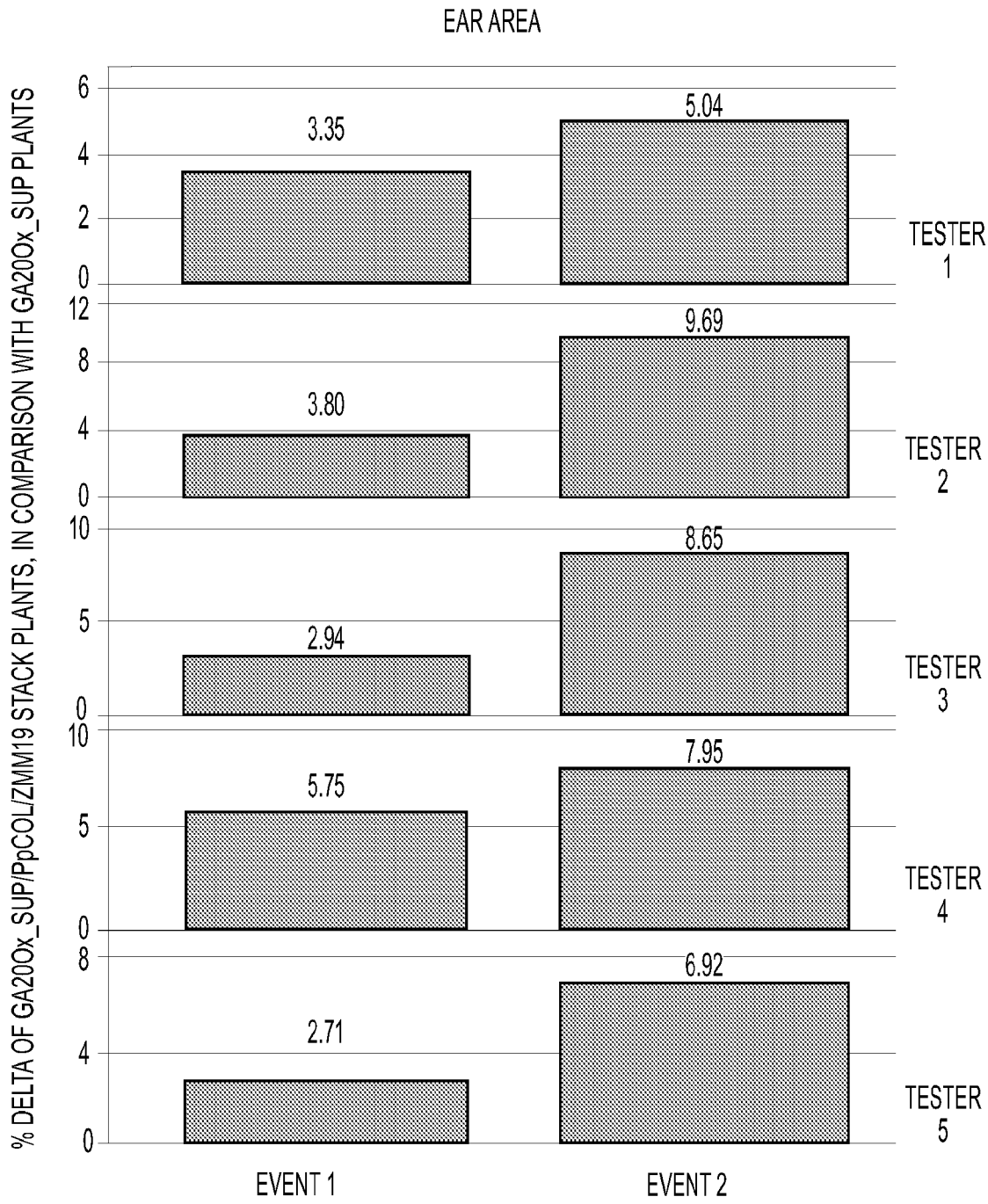
FIG. 4B-CONT

COMPOSITIONS AND METHODS FOR IMPROVING CROP YIELDS THROUGH TRAIT STACKING

CROSS REFERENCE TO RELATED APPLICATIONS

This application is a national stage application under 35 U.S.C. § 371 of International Application No. PCT/US2020/046130, filed internationally on Aug. 13, 2020, which claims the benefit of U.S. Provisional Application No. 62/886,890, filed Aug. 14, 2019, each of which is incorporated herein by reference in its entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 777052059400SEQLIST.TXT, date recorded: Feb. 8, 2022, size: 1,293,291 bytes).

FIELD

The present disclosure relates to transgenic and/or genome edited or mutated corn plants that are semi-dwarf and have one or more improved ear traits relative to a control plant, as well as methods for producing transgenic and/or genome edited or mutated corn plants through stacking.

BACKGROUND

Cereal crop yields have been steadily increasing over the past decades due to improved agronomic practices and traits. However, there continues to be a need in the art for improved corn yield through intrinsic yield gains and/or reduced yield losses from improved lodging resistance, stress tolerances and other traits.

SUMMARY

Figure 1:
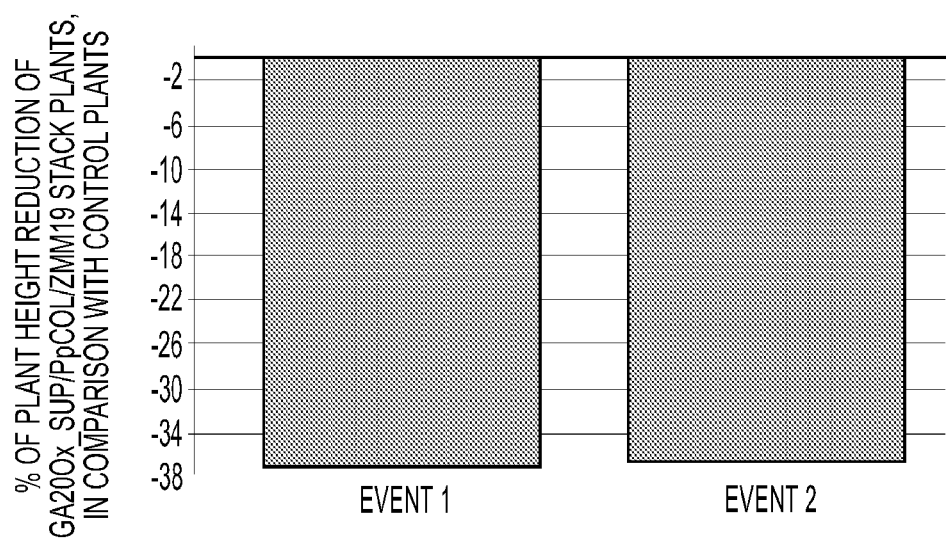
FIG. 1 shows plant heights at the R3 stage of triple stacked transgenic corn plants ("GA20Ox_SUP/PpCOL/ZMM19 stack") comprising a transgene encoding PpCOL1, a transgene encoding maize ZMM19, and a DNA sequence encoding a miRNA for the suppression of GA20 oxidase across two events, relative to control plants.

The present specification provides a modified corn plant or a plant part thereof comprising 1) a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes, 2) a second recombinant expression cassette comprising a first DNA sequence encoding a CONSTANS (CO) or CONSTANS-like (COL) polypeptide, and 3) a third recombinant expression cassette comprising a second DNA sequence encoding a MADS-box polypeptide.

The present specification also provides a plurality of modified corn plants in a field, each modified corn plant comprising 1) a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes, 2) a second recombinant expression cassette comprising a first DNA sequence encoding a CO or COL polypeptide, and 3) a third recombinant expression cassette comprising a second DNA sequence encoding a MADS-box polypeptide.

Also provided by the present specification is a method for producing a modified corn plant, the method comprising: a) introducing into a corn cell a first recombinant expression cassette comprising a coding sequence for a CO or COL polypeptide, wherein the corn cell comprises a second recombinant expression cassette comprising a transcribable DNA sequence encoding a non-coding RNA for suppression of one or more GA3 oxidase genes and/or one or more GA20 oxidase genes and a third recombinant expression cassette comprising a coding sequence for a MADS-box polypeptide; and b) regenerating or developing a modified corn plant from the corn cell, wherein the modified corn plant comprises the first, second, and third recombinant expression cassettes.

Also provided by the present specification is a method for producing a modified corn plant, the method comprising: introducing into a corn cell a first recombinant expression cassette comprising a coding sequence for a MADS-box polypeptide, wherein the corn cell comprises a second recombinant expression cassette comprising a transcribable DNA sequence encoding a non-coding RNA for suppression of one or more GA3 oxidase genes and/or one or more GA20 oxidase genes and a third recombinant expression cassette comprising a coding sequence for a CO or COL polypeptide; and b) regenerating or developing a modified corn plant from the corn cell, wherein the modified corn plant comprises the first, second, and third recombinant expression cassettes.

Also provided by the present specification is a method for producing a modified corn plant, the method comprising: a) introducing into a corn cell a first recombinant expression cassette comprising a transcribable DNA sequence encoding a non-coding RNA for suppression of one or more GA3 oxidase genes and/or one or more GA20 oxidase genes, wherein the corn cell comprises a second recombinant expression cassette comprising a coding sequence for a MADS-box polypeptide and a third recombinant expression cassette comprising a coding sequence for a CO or COL polypeptide; and b) regenerating or developing a modified corn plant from the corn cell, wherein the modified corn plant comprises the first, second, and third recombinant expression cassettes.

Also provided by the present specification is a method for producing a modified corn plant, the method comprising: a) introducing into a corn cell 1) a first recombinant expression cassette comprising a transcribable DNA sequence encoding a non-coding RNA for suppression of one or more GA3 oxidase genes and/or GA20 oxidase genes, 2) a second recombinant expression cassette comprising a coding sequence for a CO or COL polypeptide, and 3) a third recombinant expression cassette comprising a coding sequence for a MADS-box polypeptide; and b) regenerating or developing a modified corn plant from the corn cell, wherein the modified corn plant comprises the first, second, and third recombinant expression cassettes.

Further provided by the present specification is a method for producing a modified corn plant, the method comprising: a) crossing a first modified corn plant with a second modified corn plant, wherein the expression or activity of one or more endogenous GA3 oxidase genes and/or GA20 oxidase genes is reduced in the first modified corn plant relative to a wildtype control, and wherein the second modified corn plant comprises a first recombinant expression cassette comprising a coding sequence for a CO or COL polypeptide and a second recombinant expression cassette comprising a coding sequence for a MADS-box polypeptide; and b) producing a progeny corn plant comprising the first and second recombinant expression cassettes and has the reduced expression of the one or more endogenous GA3 oxidase genes and/or GA20 oxidase genes.

Further provided by the present specification is a method for producing a modified corn plant, the method comprising: a) crossing a first modified corn plant with a second modified corn plant, wherein the first modified corn plant comprises a first recombinant expression cassette comprising a coding sequence for a CO or COL polypeptide, and wherein the second modified corn plant has its expression or activity of one or more endogenous GA3 oxidase genes and/or GA20 oxidase genes reduced relative to a wildtype control, and wherein the second modified corn plant comprises a second recombinant expression cassette comprising a coding sequence for a MADS-box polypeptide; and b) producing a progeny corn plant comprising the first and second recombinant expression cassettes and has the reduced expression of the one or more endogenous GA3 oxidase genes and/or GA20 oxidase genes.

Further provided by the present specification is a method for producing a modified corn plant, the method comprising: a) crossing a first modified corn plant with a second modified corn plant, wherein the first modified corn plant comprises a first recombinant expression cassette comprising a coding sequence for a MADS-box polypeptide, and wherein the second modified corn plant has its expression or activity of one or more endogenous GA3 oxidase genes and/or GA20 oxidase genes reduced relative to a wildtype control, and wherein the second modified corn plant comprises a second recombinant expression cassette comprising a coding sequence for a CO or COL polypeptide; and b) producing a progeny corn plant comprising the first and second recombinant expression cassettes and has the reduced expression of the one or more endogenous GA3 oxidase genes and/or GA20 oxidase genes.

Further provided by the present specification is a method for producing a modified corn plant, the method comprising: a) performing one or more crossings using one or more modified corn plants, wherein the one or more modified corn plants are selected from the group consisting of 1) a modified corn plant that has its expression or activity of one or more endogenous GA3 oxidase genes and/or GA20 oxidase genes reduced relative to a wildtype control, 2) a modified corn plant comprising a recombinant expression cassette comprising a coding sequence for a CO or COL polypeptide, 3) a modified corn plant comprising a recombinant expression cassette comprising a coding sequence for a MADS-box polypeptide, 4) a modified corn plant that has its expression or activity of one or more endogenous GA3 oxidase genes and/or GA20 oxidase genes reduced relative to a wildtype control and comprises a recombinant expression cassette comprising a coding sequence for a CO or COL polypeptide, 5) a modified corn plant that has its expression or activity of one or more endogenous GA3 oxidase genes and/or GA20 oxidase genes reduced relative to a wildtype control and comprises a recombinant expression cassette comprising a coding sequence for a MADS-box polypeptide, and 6) a modified corn plant comprises a first recombinant expression cassette comprising a coding sequence for a CO or COL polypeptide and a second recombinant expression cassette comprising a coding sequence for a MADS-box polypeptide, and b) producing a progeny corn plant comprising the first and second recombinant expression cassettes and has the reduced expression of the one or more endogenous GA3 oxidase genes and/or GA20 oxidase genes.

Further provided by the present specification is a method for producing a modified corn plant, the method comprising: a) introducing into a corn cell a first recombinant expression cassette comprising a coding sequence for a CO or COL polypeptide operably linked to a first plant-expressible promoter, and wherein the corn cell comprises (1) one or more mutations and/or edits in one or more endogenous GA3 oxidase and/or GA20 oxidase genes and (2) a second recombinant expression cassette comprising a coding sequence for a MADS-box polypeptide operably linked to a second plant-expressible promoter; and b) regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

Further provided by the present specification is a method for producing a modified corn plant, the method comprising: a) introducing into a corn cell a first recombinant expression cassette comprising a coding sequence for a MADS-box polypeptide operably linked to a first plant-expressible promoter, and wherein the corn cell comprises (1) one or more mutations and/or edits in one or more endogenous GA3 oxidase and/or GA20 oxidase genes and (2) a second recombinant expression cassette comprising a coding sequence for a CO or COL polypeptide operably linked to a second plant-expressible promoter; and b) regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

Further provided by the present specification is a method for producing a modified corn plant, the method comprising: a) mutating or editing one or more endogenous GA3 oxidase genes and/or one or more GA20 oxidase genes in a corn cell, wherein the corn cell comprises (1) a first recombinant expression cassette comprising a encoding sequence for a CO or COL polypeptide operably linked to a first plant-expressible promoter and (2) a second recombinant expression cassette comprising a encoding sequence for a MADS-box polypeptide linked to a second plant-expressible promoter; and b) regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

In an aspect, the present specification provides a modified corn plant comprising 1) one or more mutations or edits at or near one or more endogenous GA20 oxidase and/or GA3 oxidase genes, wherein the expression or activity of the one or more endogenous GA20 oxidase and/or GA3 oxidase genes is reduced relative to a wildtype control plant, 2) a first recombinant expression cassette comprising a coding sequence for a CO or COL polypeptide operably linked to a first plant-expressible promoter, and 3) a second recombinant expression cassette comprising a coding sequence for a MADS-box polypeptide operably linked to a second plant-expressible promoter.

In another aspect, present specification provides a plurality of modified corn plants in a field, each modified corn plant comprising 1) one or more mutations or edits at or near one or more endogenous GA20 oxidase and/or GA3 oxidase genes, wherein the expression of the one or more endogenous GA20 oxidase and/or GA3 oxidase genes are reduced relative to a wildtype control plant, 2) a first recombinant expression cassette comprising a coding sequence for a CO or COL polypeptide operably linked to a first plant-expressible promoter, and 3) a second recombinant expression cassette comprising a coding sequence for a MADS-box polypeptide operably linked to a second plant-expressible promoter.

In yet another aspect, the present specification provides a recombinant DNA construct comprising 1) a first expression cassette comprising a transcribable DNA sequence encoding a non-coding RNA for suppression of one or more GA20 oxidase or one or more GA3 oxidase genes, wherein the transcribable DNA sequence is operably linked to a first plant-expressible promoter; 2) a second expression cassette comprising a coding sequence for a CO or COL polypeptide operably linked to a second plant-expressible promoter, and 3) a third recombinant expression cassette comprising a coding sequence for a MADS-box polypeptide operably linked to a third plant-expressible promoter. The terms "first," "second," and "third" may be used to distinguish three similarly named elements, components, constructs, cassettes, promoters, steps, etc. Unless otherwise expressly stated or implied by context, the terms "first," "second," and "third" do not mean or imply any particular order of addition or performance for such elements, components, constructs, cassettes, promoters, steps, etc. For example, the present specification also provides a recombinant DNA construct comprising 1) a first expression cassette comprising a transcribable DNA sequence encoding a non-coding RNA for suppression of one or more GA20 oxidase or one or more GA3 oxidase genes, wherein the transcribable DNA sequence is operably linked to a first plant-expressible promoter; 2) a second expression cassette comprising a coding sequence for a MADS-box polypeptide operably linked to a second plant-expressible promoter, and 3) a third recombinant expression cassette comprising a coding sequence for a CO or COL polypeptide operably linked to a third plant-expressible promoter. Indeed, any expression cassette or plant-expressible promoter provided or described herein can be a first expression cassette, a second expression cassette, a third expression cassette, or a first plant-expressible promoter, a second plant-expressible promoter, or a third plant-expressible promoter, respectively. The term "first" may also not be used—e.g., a "plant-expressible promoter" can be distinguished from a "second plant plant-expressible promoter" or a "third plant plant-expressible promoter," and an "expression cassette" can be distinguished from a "second expression cassette" or a "third expression cassette."

In an aspect, the present specification provides a modified corn plant or a plant part thereof comprising 1) a first recombinant expression cassette comprising a first DNA sequence encoding a CONSTANS (CO) or CONSTANS-like (COL) polypeptide, and 2) a second recombinant expression cassette comprising a second DNA sequence encoding a MADS-box polypeptide. In an aspect, a CO or COL polypeptide comprises a *Physcomitrella patens* CONSTANS-like 1 (PpCOL1) polypeptide. In another aspect, a MADS-box polypeptide comprises a maize ZMM19 polypeptide. Also provided are a plurality of the foregoing modified corn plants in a field. In another aspect, further provided is a seed of any of the foregoing modified corn plants, wherein the seed comprises the first and second recombinant expression cassettes. In a further aspect, also provided is a commodity or commodity product produced from the foregoing seed, wherein the commodity or commodity product comprises the first and second recombinant expression cassettes.

Further provided by the present specification is a method for producing a modified corn plant, the method comprising: (a) introducing into a corn cell a first recombinant expression cassette comprising a coding sequence for a CO or COL polypeptide, wherein the corn cell comprises a second recombinant expression cassette comprising a coding sequence for a MADS-box polypeptide; and (b) regenerating or developing a modified corn plant from the corn cell, wherein the modified corn plant comprises the first and second recombinant expression cassettes.

Further provided by the present specification is a method for producing a modified corn plant, the method comprising: (a) introducing into a corn cell a first recombinant expression cassette comprising a coding sequence for a MADS-box polypeptide, wherein the corn cell comprises a second recombinant expression cassette comprising a coding sequence for a CO or COL polypeptide; and (b) regenerating or developing a modified corn plant from the corn cell, wherein the modified corn plant comprises the first and second recombinant expression cassettes.

Further provided by the present specification is a method for producing a modified corn plant, the method comprising: (a) introducing into a corn cell 1) a first recombinant expression cassette comprising a coding sequence for a CO or COL polypeptide, and 2) a second recombinant expression cassette comprising a coding sequence for a MADS-box polypeptide; and (b) regenerating or developing a modified corn plant from the corn cell, wherein the modified corn plant comprises the first and second recombinant expression cassettes.

Also provided by the present specification is a method for producing a modified corn plant, the method comprising: (a) crossing a first modified corn plant with a second modified corn plant, wherein the first modified corn plant comprises a first recombinant expression cassette comprising a coding sequence for a CO or COL polypeptide, and wherein the second modified corn plant comprises a second recombinant expression cassette comprising a coding sequence for a MADS-box polypeptide; and (b) producing a progeny corn plant comprising the first and second recombinant expression cassettes. Also provided is a method further comprising selecting a progeny corn plant having a desired trait.

Also provided by the present specification is a method for producing a modified corn plant, the method comprising: (a) introducing into a corn cell a first recombinant expression cassette comprising a coding sequence for a CO or COL polypeptide operably linked to a first plant-expressible promoter, and wherein the corn cell comprises a second recombinant expression cassette comprising a coding sequence for a MADS-box polypeptide operably linked to a second plant-expressible promoter; and (b) regenerating or developing a modified corn plant from the corn cell, wherein the modified corn plant comprises the first and second recombinant expression cassettes.

Also provided by the present specification is a method for producing a modified corn plant, the method comprising: (a) introducing into a corn cell a first recombinant expression cassette comprising a coding sequence for a MADS-box polypeptide operably linked to a first plant-expressible promoter, and wherein the corn cell comprises a second recombinant expression cassette comprising a coding sequence for a CO or COL polypeptide operably linked to a second plant-expressible promoter; and (b) regenerating or developing a modified corn plant from the corn cell, wherein the modified corn plant comprises the first and second recombinant expression cassettes.

In another aspect, the present specification provides a modified corn plant comprising a first recombinant expression cassette comprising a coding sequence for a CO or COL polypeptide operably linked to a first plant-expressible promoter, and a second recombinant expression cassette comprising a coding sequence for a MADS-box polypeptide operably linked to a second plant-expressible promoter.

In a further aspect, the present specification provides a plurality of modified corn plants in a field, each modified corn plant comprising (a) a first recombinant expression cassette comprising a coding sequence for a CO or COL polypeptide operably linked to a first plant-expressible promoter, and (b) a second recombinant expression cassette comprising a coding sequence for a MADS-box polypeptide operably linked to a second plant-expressible promoter.

Also provided by the present specification is a recombinant DNA construct comprising a first expression cassette comprising a coding sequence for a CO or COL polypeptide operably linked to a first plant-expressible promoter, and a second recombinant expression cassette comprising a coding sequence for a MADS-box polypeptide operably linked to a second plant-expressible promoter. Also provided is a transformation vector comprising such recombinant DNA construct, or a modified corn plant or a plant part thereof comprising such recombinant DNA construct.

DESCRIPTION

Definitions

Unless defined otherwise herein, terms are to be understood according to conventional usage by those of ordinary skill in the relevant art. Examples of resources describing many of the terms related to molecular biology used herein can be found in Alberts et al., Molecular Biology of The Cell, 5th Edition, Garland Science Publishing, Inc.: New York, 2007; Rieger et al., Glossary of Genetics: Classical and Molecular, 5th edition, Springer-Verlag: New York, 1991; King et al, A Dictionary of Genetics, 6th ed., Oxford University Press: New York; 2002; and Lewin, Genes IX, Oxford University Press: New York, 2007.

Any references cited herein, including, e.g., all patents, published patent applications, and non-patent publications, are incorporated by reference in their entirety. To facilitate understanding of the disclosure, several terms and abbreviations as used herein are defined below as follows:

The term "and/or" when used in a list of two or more items, means that any one of the listed items can be employed by itself or in combination with any one or more of the listed items. For example, the expression "A and/or B" is intended to mean either or both of A and B—i.e., A alone, B alone, or A and B in combination. The expression "A, B and/or C" is intended to mean A alone, B alone, C alone, A and B in combination, A and C in combination, B and C in combination, or A, B, and C in combination.

The term "about" as used herein, is intended to qualify the numerical values that it modifies, denoting such a value as variable within a margin of error. When no particular margin of error, such as a standard deviation to a mean value, is recited, the term "about" should be understood to mean that range which would encompass the recited value and the range which would be included by rounding up or down to that figure, taking into account significant figures.

As used herein, a "plant" includes an explant, plant part, seedling, plantlet or whole plant at any stage of regeneration or development. The term "cereal plant" as used herein refers a monocotyledonous (monocot) crop plant that is in the Poaceae or Gramineae family of grasses and is typically harvested for its seed, including, for example, wheat, corn, rice, millet, barley, sorghum, oat and rye. As commonly understood, a "corn plant" or "maize plant" refers to any plant of species *Physcomitrella patens* and includes all plant varieties that can be bred with corn, including wild maize species.

As used herein, a "plant part" can refer to any organ or intact tissue of a plant, such as a meristem, shoot organ/structure (e.g., leaf, stem or node), root, flower or floral organ/structure (e.g., bract, sepal, petal, stamen, carpel, anther and ovule), seed (e.g., embryo, endosperm, and seed coat), fruit (e.g., the mature ovary), propagule, or other plant tissues (e.g., vascular tissue, dermal tissue, ground tissue, and the like), or any portion thereof. Plant parts of the present disclosure can be viable, nonviable, regenerable, and/or non-regenerable. A "propagule" can include any plant part that can grow into an entire plant.

As used herein, a "transgenic plant" refers to a plant whose genome has been altered by the integration or insertion of a recombinant DNA molecule, construct, cassette or sequence for expression of a non-coding RNA molecule, mRNA and/or protein in the plant. A transgenic plant includes an $R_0$ plant developed or regenerated from an originally transformed plant cell(s) as well as progeny transgenic plants in later generations or crosses from the $R_0$ transgenic plant that comprise the recombinant DNA molecule, construct, cassette or sequence. A plant having an integrated or inserted recombinant DNA molecule, construct, cassette or sequence is considered a transgenic plant even if the plant also has other mutation(s) or edit(s) that would not themselves be considered transgenic.

A plant cell is a biological cell of a plant, taken from a plant or derived through culture from a cell taken from a plant. As used herein, a "transgenic plant cell" refers to any plant cell that is transformed with a stably-integrated recombinant DNA molecule, construct, cassette, or sequence. A transgenic plant cell can include an originally-transformed plant cell, a transgenic plant cell of a regenerated or developed $R_0$ plant, a transgenic plant cell cultured from another transgenic plant cell, or a transgenic plant cell from any progeny plant or offspring of the transformed $R_0$ plant, including cell(s) of a plant seed or embryo, or a cultured plant cell, callus cell, etc.

As used herein, the term "transcribable DNA sequence" refers to a DNA sequence that can be transcribed into an RNA molecule. The RNA molecule can be coding or non-coding and may or may not be operably linked to a promoter and/or other regulatory sequences.

For purposes of the present disclosure, a "non-coding RNA molecule" is a RNA molecule that does not encode a protein. Non-limiting examples of a non-coding RNA molecule include a microRNA (miRNA), a miRNA precursor, a small interfering RNA (siRNA), a siRNA precursor, a small RNA (18-26 nt in length) and precursors encoding the same, a heterochromatic siRNA (hc-siRNA), a Piwi-interacting RNA (piRNA), a hairpin double strand RNA (hairpin dsRNA), a trans-acting siRNA (ta-siRNA), a naturally occurring antisense siRNA (nat-siRNA), a CRISPR RNA (crRNA), a tracer RNA (tracrRNA), a guide RNA (gRNA), and a single-guide RNA (sgRNA).

The terms "suppressing"/"suppression" or "reduced"/"reduction" when used in reference to a gene(s), refers to a lowering, reduction, or elimination of the expression level of a mRNA and/or protein encoded by the gene(s), and/or a lowering, reduction, or elimination of the activity of a protein encoded by the gene(s) in a plant, plant cell or plant tissue, at one or more stage(s) of plant development, as compared to the expression level of such target mRNA and/or protein, and/or the activity of such encoded protein, in a wild-type or control plant, cell or tissue at the same stage(s) of plant development.

As used herein, the term "consecutive" in reference to a polynucleotide or protein sequence means without deletions or gaps in the sequence.

As commonly understood in the art, a "mutation" refers to any alteration of the nucleotide sequence of the genome, extrachromosomal DNA, or other genetic element of an organism (e.g., a gene or regulatory element operably linked to a gene in a plant), such as a nucleotide insertion, deletion, inversion, substitution, duplication, etc.

The terms "percent identity" or "percent identical" as used herein in reference to two or more nucleotide or protein sequences is calculated by (i) comparing two optimally aligned sequences (nucleotide or protein) over a window of comparison, (ii) determining the number of positions at which the identical nucleic acid base (for nucleotide sequences) or amino acid residue (for proteins) occurs in both sequences to yield the number of matched positions, (iii) dividing the number of matched positions by the total number of positions in the window of comparison, and then (iv) multiplying this quotient by 100% to yield the percent identity. For purposes of calculating "percent identity" between DNA and RNA sequences, a uracil (U) of a RNA sequence is considered identical to a thymine (T) of a DNA sequence. If the window of comparison is defined as a region of alignment between two or more sequences (i.e., excluding nucleotides at the 5' and 3' ends of aligned polynucleotide sequences, or amino acids at the N-terminus and C-terminus of aligned protein sequences, that are not identical between the compared sequences), then the "percent identity" can also be referred to as a "percent alignment identity". If the "percent identity" is being calculated in relation to a reference sequence without a particular comparison window being specified, then the percent identity is determined by dividing the number of matched positions over the region of alignment by the total length of the reference sequence. Accordingly, for purposes of the present disclosure, when two sequences (query and subject) are optimally aligned (with allowance for gaps in their alignment), the "percent identity" for the query sequence is equal to the number of identical positions between the two sequences divided by the total number of positions in the query sequence over its length (or a comparison window), which is then multiplied by 100%.

It is recognized that residue positions of proteins that are not identical often differ by conservative amino acid substitutions, where amino acid residues are substituted for other amino acid residues with similar size and chemical properties (e.g., charge, hydrophobicity, polarity, etc.), and therefore may not change the functional properties of the molecule. When sequences differ in conservative substitutions, the percent sequence similarity can be adjusted upwards to correct for the conservative nature of the non-identical substitution(s). Sequences that differ by such conservative substitutions are said to have "sequence similarity" or "similarity." Thus, "percent similarity" or "percent similar" as used herein in reference to two or more protein sequences is calculated by (i) comparing two optimally aligned protein sequences over a window of comparison, (ii) determining the number of positions at which the same or similar amino acid residue occurs in both sequences to yield the number of matched positions, (iii) dividing the number of matched positions by the total number of positions in the window of comparison (or the total length of the reference or query protein if a window of comparison is not specified), and then (iv) multiplying this quotient by 100% to yield the percent similarity. Conservative amino acid substitutions for proteins are known in the art.

For optimal alignment of sequences to calculate their percent identity or similarity, various pair-wise or multiple sequence alignment algorithms and programs are known in the art, such as ClustalW, or Basic Local Alignment Search Tool® (BLAST®), etc., that can be used to compare the sequence identity or similarity between two or more nucleotide or protein sequences. Although other alignment and comparison methods are known in the art, the alignment between two sequences (including the percent identity ranges described above) can be as determined by the ClustalW or BLAST® algorithm, see, e.g., Chenna R. et al., "Multiple sequence alignment with the Clustal series of programs," *Nucleic Acids Research* 31: 3497-3500 (2003); Thompson J D et al., "Clustal W: Improving the sensitivity of progressive multiple sequence alignment through sequence weighting, position-specific gap penalties and weight matrix choice," *Nucleic Acids Research* 22: 4673-4680 (1994); and Larkin M A et al., "Clustal W and Clustal X version 2.0," *Bioinformatics* 23: 2947-48 (2007); and Altschul, S. F., Gish, W., Miller, W., Myers, E. W. & Lipman, D. J. (1990) "Basic local alignment search tool." *J. Mol. Biol.* 215:403-410 (1990), the entire contents and disclosures of which are incorporated herein by reference.

The terms "percent complementarity" or "percent complementary", as used herein in reference to two nucleotide sequences, is similar to the concept of percent identity but refers to the percentage of nucleotides of a query sequence that optimally base-pair or hybridize to nucleotides of a subject sequence when the query and subject sequences are linearly arranged and optimally base paired without secondary folding structures, such as loops, stems or hairpins. Such a percent complementarity can be between two DNA strands, two RNA strands, or a DNA strand and a RNA strand. The "percent complementarity" is calculated by (i) optimally base-pairing or hybridizing the two nucleotide sequences in a linear and fully extended arrangement (i.e., without folding or secondary structures) over a window of comparison, (ii) determining the number of positions that base-pair between the two sequences over the window of comparison to yield the number of complementary positions, (iii) dividing the number of complementary positions by the total number of positions in the window of comparison, and (iv) multiplying this quotient by 100% to yield the percent complementarity of the two sequences. Optimal base pairing of two sequences can be determined based on the known pairings of nucleotide bases, such as G-C, A-T, and A-U, through hydrogen bonding. If the "percent complementarity" is being calculated in relation to a reference sequence without specifying a particular comparison window, then the percent identity is determined by dividing the number of complementary positions between the two linear sequences by the total length of the reference sequence. Thus, for purposes of the present disclosure, when two sequences (query and subject) are optimally base-paired (with allowance for mismatches or non-base-paired nucleotides but without folding or secondary structures), the "percent complementarity" for the query sequence is equal to the number of base-paired positions between the two sequences divided by the total number of positions in the query sequence over its length (or by the number of positions in the query sequence over a comparison window), which is then multiplied by 100%.

The term "operably linked" refers to a functional linkage between a promoter or other regulatory element and an associated transcribable DNA sequence or coding sequence of a gene (or transgene), such that the promoter, etc., operates or functions to initiate, assist, affect, cause, and/or promote the transcription and expression of the associated transcribable DNA sequence or coding sequence, at least in certain cell(s), tissue(s), developmental stage(s), and/or condition(s).

As commonly understood in the art, the term "promoter" can generally refer to a DNA sequence that contains an RNA polymerase binding site, transcription start site, and/or TATA box and assists or promotes the transcription and expression of an associated transcribable polynucleotide sequence and/or gene (or transgene). A promoter can be synthetically produced, varied or derived from a known or naturally occurring promoter sequence or other promoter sequence. A promoter can also include a chimeric promoter comprising a combination of two or more heterologous sequences. A promoter of the present disclosure can thus include variants of promoter sequences that are similar in composition, but not identical to, other promoter sequence (s) known or provided herein. A promoter can be classified according to a variety of criteria relating to the pattern of expression of an associated coding or transcribable sequence or gene (including a transgene) operably linked to the promoter, such as constitutive, developmental, tissue-specific, inducible, etc. Promoters that drive expression in all or most tissues of the plant are referred to as "constitutive" promoters. Promoters that drive expression during certain periods or stages of development are referred to as "developmental" promoters. Promoters that drive enhanced expression in certain tissues of the plant relative to other plant tissues are referred to as "tissue-enhanced" or "tissue-preferred" promoters. Thus, a "tissue-preferred" promoter causes relatively higher or preferential expression in a specific tissue(s) of the plant, but with lower levels of expression in other tissue(s) of the plant. Promoters that express within a specific tissue(s) of the plant, with little or no expression in other plant tissues, are referred to as "tissue-specific" promoters. An "inducible" promoter is a promoter that initiates transcription in response to an environmental stimulus such as cold, drought or light, or other stimuli, such as wounding or chemical application. A promoter can also be classified in terms of its origin, such as being heterologous, homologous, chimeric, synthetic, etc.

As used herein, a "plant-expressible promoter" refers to a promoter that can initiate, assist, affect, cause, and/or promote the transcription and expression of its associated transcribable DNA sequence, coding sequence or gene in a corn plant cell or tissue.

As used herein, a "heterologous plant-expressible promoter" refers to a plant-expressible promoter which does not naturally occur adjacent to or associated with the referenced gene or nucleic acid sequence in its natural environment, but which is positioned by laboratory manipulation.

As used herein, a "vascular promoter" refers to a plant-expressible promoter that drives, causes or initiates expression of a transcribable DNA sequence or transgene operably linked to such promoter in one or more vascular tissue(s) of the plant, even if the promoter is also expressed in other non-vascular plant cell(s) or tissue(s). Such vascular tissue(s) can comprise one or more of the phloem, vascular parenchymal, and/or bundle sheath cell(s) or tissue(s) of the plant. A "vascular promoter" is distinguished from a constitutive promoter in that it has a regulated and relatively more limited pattern of expression that includes one or more vascular tissue(s) of the plant. A vascular promoter includes both vascular-specific promoters and vascular-preferred promoters.

As used herein, a "leaf promoter" refers to a plant-expressible promoter that drives, causes or initiates expression of a transcribable DNA sequence or transgene operably linked to such promoter in one or more leaf tissue(s) of the plant, even if the promoter is also expressed in other non-leaf plant cell(s) or tissue(s). A leaf promoter includes both leaf-specific promoters and leaf-preferred promoters. A "leaf promoter" is distinguished from a vascular promoter in that it is expressed more predominantly or exclusively in leaf tissue(s) of the plant relative to other plant tissues, whereas a vascular promoter is expressed in vascular tissue(s) more generally including vascular tissue(s) outside of the leaf, such as the vascular tissue(s) of the stem, or stem and leaves, of the plant.

As used herein, a "meristem promoter" refers to any meristem-preferred promoter or meristem-specific promoter. A meristem promoter includes any promoter which causes or drives, or can cause or drive, meristem-specific or meristem-preferred expression of a gene or transgene operably linked to the promoter in a corn or maize seed, including any such promoter from a monocot or Poaceae plant, such as maize, barley, wheat, oat, millet, sorghum, rice, etc. A meristem-preferred promoter refers to a promoter that preferentially or predominantly causes or drives expression of a gene (or transgene) operably linked to the promoter in one or more meristem tissues of a corn or maize plant although the meristem-preferred promoter may also cause or drive expression of the gene (or transgene) operably linked to the promoter in other tissues. A meristem-specific promoter refers to a promoter that causes or drives expression of a gene (or transgene) operably linked to the promoter specifically in one or more meristem tissues of a corn plant.

According to present embodiments, a meristem promoter can include any meristem promoter known in the art to cause or drive expression of a gene (or transgene) in one or more meristem tissues of a corn or maize plant, such as for example, a promoter from a WAK1 or WAK2 gene (see, e.g., Wagner et al., The Plant Cell 13(2): 303-318 (2001)), a metallothionein gene, a rice OSH1 gene (see, e.g., Sato et al, PNAS USA 93(15): 8117-8122 (1996)), a PCNA gene (see, e.g., Kosugi et al., Nucl. Acids Res. 19: 1571-1576 (1991)), a histone gene, such as a maize histone H3C4 gene (see, e.g., Ohtsubo et al., Pant Mol Biol 23(3):553-565 (1993); and Atanassova et al., Plant Mol Biol, 37: 275-285 (1998)), a maize WUSCHEL gene or a maize RAMOSA3 gene (see, e.g., Wu et al Int. J. Dev. Biol. 57: 535-543 (2013)), or a functional portion of any of the foregoing known meristem promoters, or a promoter sequence that is at least 60% identical, at least 65% identical, at least 70% identical, at least 75% identical, at least 80% identical, at least 85% identical, at least 90% identical, at least 95% identical, at least 96% identical, at least 97% identical, at least 98% identical, at least 99% identical, or 100% identical to any of the foregoing known seed promoters, or any functional portion thereof. In one aspect, a meristem promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or both of SEQ ID NOs: 484 and 485, or a functional portion thereof. All of the above-cited references are incorporated herein by reference in their entirety.

As used herein, a "seed promoter" or a "kernel promoter" refers to any seed-preferred (or kernel-preferred) promoter or any seed-specific (or kernel-specific) promoter. A seed or kernel promoter includes any promoter which causes or drives, or can cause or drive, seed-specific or seed-preferred expression of a gene or transgene operably linked to the promoter in a corn or maize seed, including any such promoter from a monocot or Poaceae plant, such as maize, barley, wheat, oat, millet, sorghum, rice, etc.

As used herein, a "seed-preferred" or "kernel-preferred" promoter refers to a promoter that preferentially or predominantly causes or drives expression of a gene (or transgene) operably linked to the promoter in one or more tissues of a seed or kernel of a corn or maize plant, such as in one or more of a seed endosperm, embryo, scutellum, etc., although the seed-preferred or kernel-preferred promoter may also cause or drive expression of the gene (or transgene) operably linked to the promoter in other tissues. A "seed-specific" or "kernel-specific" promoter refers to a promoter that causes or drives expression of a gene (or transgene) operably linked to the promoter specifically in one or more tissues of a seed or kernel of a corn or maize plant, such as in one or more of a seed endosperm, embryo, scutellum, etc.

According to present embodiments, a seed or kernel promoter can include any seed or kernel promoter known in the art to cause or drive expression of a gene (or transgene) in one or more tissues of a corn or maize seed, such as for example, a promoter from a zein gene (see, e.g., Matzke et al., Plant Mol Biol, 14(3): 323-32 (1990); The Plant Cell, 13(10): 2297-2318 (2001); and Joshi et al., Physiol Mol Biol Plants, 21(1): 35-42 (2015)), such as alpha-zeins, gamma-zeins, and delta-zeins, including maize 15 kDa zein, 19 kDa zein, 22 kDa zein, or 27 kDa zein, or other prolamin gene, such as a B1-, C- or D-hordein gene, an alpha-, beta- or gamma-gliadin gene, a secalin gene, a kafirin gene, an avenin gene, etc. (see, e.g., Horvath et al., PNAS 97(4): 1914-19 (2000); Cho et al., Theor Appl Gen 98:1253-62

(1999); Muller et al., The Plant Journal 4(2):343-355 (1993); Sorensen et al., Mol and Gen Genet 250(6):750-60 (1996); Van Herpen et al., Ann Bot 102(3) 331-342 (2008); Aryan et al., Mol and Gen Genet 225(1):65-71 (1991); Rafalski et al., EMBO J 3(6):1409-15 (1984); Piston et al., Mol Breed 23(4):655-667 (2009); Derose et al., Plant Mol Biol 32(6): 1029-35 (1997); and PCT Application Pub. No. WO 1999/ 016890); a granule bound starch synthase (waxy) gene (see, e.g., Merida et al., Plant Physiol. 120(2):401-410 (1999)), a LMW or HMW glutenin or glutelin gene (see, e.g., Thilmony et al., GM Crops Food, 5(1): 36-43 (2014); Furtado et al., Plant Biotechnol J 7(3):240-53 (2009); Furtado et al., Plant Biotechnol J 6(7):679-93 (2008); Lamacchia et al., J Exp Bot 52(355):243-50 (2001); Osvald et al., In Vitro Cellular & Dev Biol. Plant 44(1): 1-7 (2008); Qu et al., J Exp Bot 59(9):2417-2424 (2008); and Colot et al., Mol Gen Genet 216:81-90 (1989)), a Cim1 (cytokinin-induced message) gene, a seed-preferred ADP-glucose pyrophosphorylase gene, such as a maize shrunken gene, a globulin-1 (Glb-1) or alpha-globulin gene (see, e.g., Wu et al., Plant Cell Physiology 39(8) 885-889 (1998); and Nakase et al. Plant Mol. Biol. 33(3):513-S22 (1997)), a REB1/OHP-1 gene, a DOF gene (see, e.g., Mena et al, The Plant Journal, 116(1): 53-62 (1998), a lipid transfer protein (ltp) gene, such as a Ltp1 or Ltp2 gene (see, e.g., PCT Application Pub Nos. WO 1995/15389 and WO 1995/23230; and Kalla et al., The Plant J. 6(6): 849-60 (1994)), a SPA gene (see, e.g., Albani et al, The Plant Cell 9:171-184 (1997), a rice OSH1 gene (see, e.g., Sato et al, PNAS USA 93(15): 8117-8122 (1996)), an oleosin gene (see, e.g., Wu et al, J. Biochem 123: 386-391 (1998)), an ESR gene (see, e.g., Opsahl-Ferstad et al., Plant J. 12(1): 235-46 (1997), a KNOX gene (see, e.g., Postma-Haarsma et al, Plant Mol. Biol. 39(2): 257-71 (1999)), an amylase gene (see, e.g., Lanahan et al, The Plant Cell 4: 203-211 (1992); Yu et al., Gene 122(2): 247-253 (1992); and Skriver et al, PNAS USA 88(16): 7266-7270 (1991)), cathepsin Beta-like gene (see, e.g., Cejudo et al., Plant Mol Biol 20(5): 849-856 (1992)), chitinase or Chi26 gene (see, e.g., Leah et al., Plant J. 6(4): 579-89, 1994), B-Peru gene allele (see, e.g., Selinger et al., Genetics 149(2); 1125-38 (1998)), blz2 gene (see, e.g., Onate et al., J Biol Chem 274(14): 9175-82 (1999)), a trypsin inhibitor gene, such as Itr1 (see, e.g., Diaz et al., Mol Gen Genet 248(5): 592-8 (1995)), an end1 or end2 gene (see, e.g., PCT Application Pub No. WO 2000/12733), an alanine aminotransferase gene (see, e.g., Qu et al., Plant Biotechnol. J. 2: 113-125 (2004)), a glycine rich RNA binding (GRP) protein (see, e.g., U.S. Pat. No. 6,376,750), a ZM.39486 gene (see, e.g., U.S. Pat. No. 7,518,035), or a milps (myo-inositol-1-phosphate synthase) gene (see, e.g., U.S. Pat. No. 6,225,529), or a PR00005, PR00058, PRO0095, PRO0117, PRO0151, PRO0173, or PRO0175 promoter (see, e.g., WO 2004/070039), or a functional portion of any of the foregoing known seed promoters, or a promoter sequence that is at least 60% identical, at least 65% identical, at least 70% identical, at least 75% identical, at least 80% identical, at least 85% identical, at least 90% identical, at least 95% identical, at least 96% identical, at least 97% identical, at least 98% identical, at least 99% identical, or 100% identical to any of the foregoing known seed promoters, or any functional portion thereof. In one aspect, a seed promoter or a kernel promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 486-491, or a functional portion thereof. All of the above-cited references are incorporated herein by reference in their entirety.

As used herein, a "root promoter" refers to any root-preferred promoter or root-specific promoter. A root promoter includes any promoter which causes or drives, or can cause or drive, root-specific or root-preferred expression of a gene or transgene operably linked to the promoter in a corn or maize seed, including any such promoter from a monocot or Poaceae plant, such as maize, barley, wheat, oat, millet, sorghum, rice, etc. As used herein, a root-preferred promoter refers to a promoter that preferentially or predominantly causes or drives expression of a gene (or transgene) operably linked to the promoter in one or more root tissues of a corn or maize plant, such as the root endodermis, root epidermis, root vascular tissue, etc., although the root-preferred promoter may also cause or drive expression of the gene (or transgene) operably linked to the promoter in other tissues. A root-specific promoter refers to a promoter that causes or drives expression of a gene (or transgene) operably linked to the promoter specifically in one or more root tissues of a corn plant, such as the root endodermis, root epidermis, root vascular tissue, etc.

According to present embodiments, a root promoter can include any root promoter known in the art to cause or drive expression of a gene (or transgene) in one or more root tissues of a corn or maize plant, such as for example, a root-specific subdomain of the CaMV 35S promoter (see, e.g., Lam et al., PNAS USA, 86:7890-7894 (1989)) or other root cell specific promoters (see, e.g., Plant Physiol., 93:1203-1211 (1990)), one of the YP0128, YP0275, PT0625, PT0660, PT0683, PT0758, PT0613, PT0672, PT0678, PT0688, and PT0837 promoters (see, e.g., US Patent Pub. No. 2008/0131581), a GL5 promoter (see, e.g., US Patent Pub. No. 2007/174938), or a promoter from an acid chitanse gene, a RCc2 or RCc3 gene (see, e.g., U.S. Pat. No. 7,547,774 (rice); PCT Pub. No. WO 2009/126470 (millet); and Plant Mol Biol. 27(2): 237-48 (1995)), or a Zm.PIIG gene (see, e.g., U.S. Pat. No. 7,491,813), or a functional portion of any of the foregoing known root promoters, or a promoter sequence that is at least 60% identical, at least 65% identical, at least 70% identical, at least 75% identical, at least 80% identical, at least 85% identical, at least 90% identical, at least 95% identical, at least 96% identical, at least 97% identical, at least 98% identical, at least 99% identical, or 100% identical to any of the foregoing known root promoters, or any functional portion thereof. In an aspect, such a root promoter is an *Oryza sativa* Rcc3 gene promoter. In an aspect, such a root promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 178, or a functional portion thereof.

The term "heterologous" in reference to a promoter or other regulatory sequence in relation to an associated polynucleotide sequence (e.g., a transcribable DNA sequence or coding sequence or gene) is a promoter or regulatory sequence that is not operably linked to such associated polynucleotide sequence in nature—e.g., the promoter or regulatory sequence has a different origin relative to the associated polynucleotide sequence and/or the promoter or regulatory sequence is not naturally occurring in a plant species to be transformed with the promoter or regulatory sequence.

The term "recombinant" in reference to a polynucleotide (DNA or RNA) molecule, protein, construct, vector, etc., refers to a polynucleotide or protein molecule or sequence that is man-made and not normally found in nature, and/or is present in a context in which it is not normally found in nature, including a polynucleotide (DNA or RNA) molecule, protein, construct, etc., comprising a combination of two or more polynucleotide or protein sequences that would not naturally occur together in the same manner without human intervention, such as a polynucleotide molecule, protein, construct, etc., comprising at least two polynucleotide or protein sequences that are operably linked but heterologous with respect to each other. For example, the term "recombinant" can refer to any combination of two or more DNA or protein sequences in the same molecule (e.g., a plasmid, construct, vector, chromosome, protein, etc.) where such a combination is man-made and not normally found in nature. As used in this definition, the phrase "not normally found in nature" means not found in nature without human introduction. A recombinant polynucleotide or protein molecule, construct, etc., can comprise polynucleotide or protein sequence(s) that is/are (i) separated from other polynucleotide or protein sequence(s) that exist in proximity to each other in nature, and/or (ii) adjacent to (or contiguous with) other polynucleotide or protein sequence(s) that are not naturally in proximity with each other. Such a recombinant polynucleotide molecule, protein, construct, etc., can also refer to a polynucleotide or protein molecule or sequence that has been genetically engineered and/or constructed outside of a cell. For example, a recombinant DNA molecule can comprise any engineered or man-made plasmid, vector, etc., and can include a linear or circular DNA molecule. Such plasmids, vectors, etc., can contain various maintenance elements including a prokaryotic origin of replication and selectable marker, as well as one or more transgenes or expression cassettes perhaps in addition to a plant selectable marker gene, etc.

As used herein, the term "isolated" refers to at least partially separating a molecule from other molecules typically associated with it in its natural state. In an aspect, the term "isolated" refers to a DNA molecule that is separated from the nucleic acids that normally flank the DNA molecule in its natural state. For example, a DNA molecule encoding a protein that is naturally present in a bacterium would be an isolated DNA molecule if it was not within the DNA of the bacterium from which the DNA molecule encoding the protein is naturally found. Thus, a DNA molecule fused to or operably linked to one or more other DNA molecule(s) with which it would not be associated in nature, for example as the result of recombinant DNA or plant transformation techniques, is considered isolated herein. Such molecules are considered isolated even when integrated into the chromosome of a host cell or present in a nucleic acid solution with other DNA molecules.

As used herein, an "encoding region" or "coding region" refers to a portion of a polynucleotide that encodes a functional unit or molecule (e.g., without being limiting, a mRNA, protein, or non-coding RNA sequence or molecule).

As used herein, "modified" in the context of a plant, plant seed, plant part, plant cell, and/or plant genome, refers to a plant, plant seed, plant part, plant cell, and/or plant genome comprising an engineered change in the expression level and/or coding sequence of one or more gene(s) relative to a wild-type or control plant, plant seed, plant part, plant cell, and/or plant genome, such as via a transgenic event or a genome editing event or mutation affecting the expression level or activity of one or more genes. Modified plants, plant parts, seeds, etc., can be subjected to or created by mutagenesis, genome editing or site-directed integration (e.g., without being limiting, via methods using site-specific nucleases), genetic transformation (e.g., without being limiting, via methods of *Agrobacterium* transformation or microprojectile bombardment), or a combination thereof. Such "modified" plants, plant seeds, plant parts, and plant cells include plants, plant seeds, plant parts, and plant cells that are offspring or derived from "modified" plants, plant seeds, plant parts, and plant cells that retain the molecular change (e.g., change in expression level and/or activity) to the one or more genes. A modified seed provided herein can give rise to a modified plant provided herein. A modified plant, plant seed, plant part, plant cell, or plant genome provided herein can comprise a recombinant DNA construct or vector or genome edit as provided herein. A "modified plant product" can be any product made from a modified plant, plant part, plant cell, or plant chromosome provided herein, or any portion or component thereof.

As used herein, the term "control plant" (or likewise a "control" plant seed, plant part, plant cell and/or plant genome) refers to a plant (or plant seed, plant part, plant cell and/or plant genome) that is used for comparison to a modified plant (or modified plant seed, plant part, plant cell and/or plant genome) and has the same or similar genetic background (e.g., same parental lines, hybrid cross, inbred line, testers, etc.) as the modified plant (or plant seed, plant part, plant cell and/or plant genome), except for a transgene, expression cassette, mutation, and/or genome edit affecting one or more genes. For purposes of comparison to a modified plant, plant seed, plant part, plant cell and/or plant genome, a "wild-type plant" (or likewise a "wild-type" plant seed, plant part, plant cell and/or plant genome) refers to a non-transgenic, non-mutated, and non-genome edited control plant, plant seed, plant part, plant cell and/or plant genome. Alternatively as can be specified herein, such a "control plant" (or likewise a "control" plant seed, plant part, plant cell and/or plant genome) can refer to a plant (or plant seed, plant part, plant cell and/or plant genome) that (i) is used for comparison to a modified plant (or modified plant seed, plant part, plant cell and/or plant genome) having a stack of two or more transgene(s), expression cassette(s), mutation(s) and/or genome edit(s), (ii) has the same or similar genetic background (e.g., same parental lines, hybrid cross, inbred line, testers, etc.) as the modified plant (or plant seed, plant part, plant cell and/or plant genome), but (iii) lacks at least one of the two or more transgene(s), expression cassette(s), mutation(s) and/or genome edit(s) of the modified plant (e.g., a stack in comparison to a single of one of the members of the stack). As used herein, such a "control" plant, plant seed, plant part, plant cell and/or plant genome can also be a plant, plant seed, plant part, plant cell and/or plant genome having a similar (but not the same or identical) genetic background to a modified plant, plant seed, plant part, plant cell and/or plant genome, if deemed sufficiently similar for comparison of the characteristics or traits to be analyzed.

As used herein, "crossed" or "cross" means to produce progeny via fertilization (e.g., cells, seeds or plants) and includes crosses between plants (sexual) and self-fertilization (selfing).

As used herein, "ear trait" of a corn plant refers to a characteristic of an ear of a corn plant. In an aspect, an ear trait can include, but is not limited to, ear area, single kernel weight, ear fresh weight, and/or number of florets. In another aspect, an ear trait can include, but is not limited to, ear diameter, ear length, ear tip void, ear void, ear volume, kernel number, kernel number per row, kernel number per ear, kernels per field area, kernel rank, kernel row number, kernel weight, single kernel weight, yield, and/or grain yield estimate. In yet another aspect, an ear trait can include, but is not limited to, ear attitude, ear cob color, ear cob diameter, ear cob strength, ear dry husk color, ear fresh husk color, ear husk bract, ear husk cover, ear husk opening, ear number per stalk, ear shank length, ear shelling percent, ear silk color, ear taper, ear weight, ear rot rating, kernel aleurone color, kernel cap color, kernel endosperm color, kernel endosperm type, kernel grade, kernel length, kernel pericarp color, kernel row direction, kernel side color, kernel thickness, kernel type, kernel width, cob weight, and/or prolificacy. A modified or genome edited/mutated corn plant of the present disclosure exhibits one or more improved ear trait compared to a control corn plant. In an aspect, a modified or genome edited/mutated corn plant exhibits an increased ear area relative to a control corn plant. In an aspect, a modified or genome edited/mutated corn plant exhibits increased kernel weight relative to a control corn plant. In an aspect, a modified or genome edited/mutated corn plant exhibits an increased ear fresh weight relative to a control corn plant.

As used herein, "yield" refers to the total amount of an agricultural product (e.g., seeds, fruit, etc.) produced or harvested from a plurality of crop plants per unit area of land cultivation (e.g., a field of crop plants) as understood in the art. Yield can be measured or estimated in a greenhouse, in a field, or under specific environment, treatment and/or stress conditions. For example, as known and understood in the art, yield can be measured in units of kilograms per hectare, bushels per acre, or the like. Indeed, yield can be measured in terms of "broad acreage yield" or "BAY" as known and understood in the art.

As used herein, "comparable conditions" for plants refers to the same or similar environmental conditions and agronomic practices for growing and making meaningful comparisons between two or more plant genotypes so that neither environmental conditions nor agronomic practices would significantly contribute to, or explain, any differences observed between the two or more plant genotypes. Environmental conditions include, for example, light, temperature, water, humidity, soil, and nutrition (e.g., nitrogen and phosphorus).

As used herein, a "targeted genome editing technique" refers to any method, protocol, or technique that allows the precise and/or targeted editing of a specific location in a genome of a plant (i.e., the editing is largely or completely non-random) using a site-specific nuclease, such as a meganuclease, a zinc-finger nuclease (ZFN), an RNA-guided endonuclease (e.g., the CRISPR/Cas9 system), a TALE-endonuclease (TALEN), a recombinase, or a transposase.

As used herein, "editing" or "genome editing" refers to generating a targeted mutation, deletion, inversion or substitution of at least 1, at least 2, at least 3, at least 4, at least 5, at least 6, at least 7, at least 8, at least 9, at least 10, at least 15, at least 20, at least 25, at least 30, at least 35, at least 40, at least 45, at least 50, at least 75, at least 100, at least 250, at least 500, at least 1000, at least 2500, at least 5000, at least 10,000, or at least 25,000 nucleotides of an endogenous plant genome nucleic acid sequence using a targeted genome editing technique. As used herein, "editing" or "genome editing" also encompasses the targeted insertion or site-directed integration of at least 1, at least 2, at least 3, at least 4, at least 5, at least 6, at least 7, at least 8, at least 9, at least 10, at least 15, at least 20, at least 25, at least 30, at least 35, at least 40, at least 45, at least 50, at least 75, at least 100, at least 250, at least 500, at least 750, at least 1000, at least 1500, at least 2000, at least 2500, at least 3000, at least 4000, at least 5000, at least 10,000, or at least 25,000 nucleotides into the endogenous genome of a plant using a targeted genome editing technique.

As used herein, a "target site" for genome editing refers to the location of a polynucleotide sequence within a plant genome that is targeted and cleaved by a site-specific nuclease introducing a double stranded break (or single-stranded nick) into the nucleic acid backbone of the polynucleotide sequence and/or its complementary DNA strand. A site-specific nuclease can bind to a target site, such as via a non-coding guide RNA (e.g., without being limiting, a CRISPR RNA (crRNA) or a single-guide RNA (sgRNA) as described further below). A non-coding guide RNA provided herein can be complementary to a target site (e.g., complementary to either strand of a double-stranded nucleic acid molecule or chromosome at the target site). A "target site" also refers to the location of a polynucleotide sequence within a plant genome that is bound and cleaved by another site-specific nuclease that may not be guided by a non-coding RNA molecule, such as a meganuclease, zinc finger nuclease (ZFN), or a transcription activator-like effector nuclease (TALEN), to introduce a double stranded break (or single-stranded nick) into the polynucleotide sequence and/or its complementary DNA strand. As used herein, a "target region" or a "targeted region" refers to a polynucleotide sequence or region that is flanked by two or more target sites. Without being limiting, in some aspects a target region can be subjected to a mutation, deletion, insertion or inversion. As used herein, "flanked" when used to describe a target region of a polynucleotide sequence or molecule, refers to two or more target sites of the polynucleotide sequence or molecule surrounding the target region, with one target site on each side of the target region.

Apart from genome editing, the term "target site" can also be used in the context of gene suppression to refer to a portion of a mRNA molecule (e.g., a "recognition site") that is complementary to at least a portion of a non-coding RNA molecule (e.g., a miRNA, siRNA, etc.) encoded by a suppression construct. As used herein, a "target site" for a RNA-guided nuclease can comprise the sequence of either complementary strand of a double-stranded nucleic acid (DNA) molecule or chromosome at the target site. It will be appreciated that perfect identity or complementarity may not be required for a non-coding guide RNA to bind or hybridize to a target site. For example, at least 1, at least 2, at least 3, at least 4, at least 5, at least 6, at least 7, or at least 8 mismatches (or more) between a target site and a non-coding RNA can be tolerated.

As used herein, a "donor molecule", "donor template", or "donor template molecule" (collectively a "donor template"), which can be a recombinant DNA donor template, is defined as a nucleic acid molecule having a nucleic acid template or insertion sequence for site-directed, targeted insertion or recombination into the genome of a plant cell via repair of a nick or double-stranded DNA break in the genome of a plant cell. For example, a "donor template" can be used for site-directed integration of a transgene or suppression construct, or as a template to introduce a mutation, such as an insertion, deletion, etc., into a target site within the genome of a plant. A targeted genome editing technique provided herein can comprise the use of one or more, two or more, three or more, four or more, or five or more donor molecules or templates. A donor template can be a single-stranded or double-stranded DNA or RNA molecule or plasmid. A donor template can also have at least one homology sequence or homology arm, such as two homology arms, to direct the integration of a mutation or insertion sequence into a target site within the genome of a plant via homologous recombination, wherein the homology sequence or homology arm(s) are identical or complementary, or have a percent identity or percent complementarity, to a sequence at or near the target site within the genome of the plant. When a donor template comprises homology arm(s) and an insertion sequence, the homology arm(s) will flank or surround the insertion sequence of the donor template. Further, the donor template can be linear or circular, and can be single-stranded or double-stranded. A donor template can be delivered to the cell as a naked nucleic acid (e.g., via particle bombardment), as a complex with one or more delivery agents (e.g., liposomes, proteins, poloxamers, T-strand encapsulated with proteins, etc.), or contained in a bacterial or viral delivery vehicle, such as, for example, *Agrobacterium tumefaciens* or a geminivirus, respectively.

An insertion sequence of a donor template can comprise one or more genes or sequences that each encode a transcribed non-coding RNA or mRNA sequence and/or a translated protein sequence. A transcribed sequence or gene of a donor template can encode a protein or a non-coding RNA molecule. An insertion sequence of a donor template can comprise a polynucleotide sequence that does not comprise a functional gene or an entire gene sequence (e.g., the donor template can simply comprise regulatory sequences, such as a promoter sequence, or only a portion of a gene or coding sequence), or may not contain any identifiable gene expression elements or any actively transcribed gene sequence. An insertion sequence of a donor template provided herein can comprise a transcribable DNA sequence that can be transcribed into an RNA molecule, which can be non-coding and may or may not be operably linked to a promoter and/or other regulatory sequence.

As used herein, the term "guide RNA" or "gRNA" is a short RNA sequence comprising (1) a structural or scaffold RNA sequence necessary for binding or interacting with an RNA-guided nuclease and/or with other RNA molecules (e.g., tracrRNA), and (2) an RNA sequence (referred to herein as a "guide sequence") that is identical or complementary to a target sequence or a target site. A "single-chain guide RNA" (or "sgRNA") is a RNA molecule comprising a crRNA covalently linked a tracrRNA by a linker sequence, which can be expressed as a single RNA transcript or molecule. The guide RNA comprises a guide or targeting sequence (a "guide sequence") that is identical or complementary to a target site within the plant genome, such as at or near a GA oxidase gene. A protospacer-adjacent motif (PAM) can be present in the genome immediately adjacent and upstream to the 5' end of the genomic target site sequence complementary to the targeting sequence of the guide RNA—i.e., immediately downstream (3') to the sense (+) strand of the genomic target site (relative to the targeting sequence of the guide RNA) as known in the art. The genomic PAM sequence on the sense (+) strand adjacent to the target site (relative to the targeting sequence of the guide RNA) can comprise 5'-NGG-3'. However, the corresponding sequence of the guide RNA (i.e., immediately downstream (3') to the targeting sequence of the guide RNA) can generally not be complementary to the genomic PAM sequence. The guide RNA can typically be a non-coding RNA molecule that does not encode a protein.

As used herein, an "RNA-guided nuclease" refers to an RNA-guided DNA endonuclease, which may be associated with a CRISPR system. Non-limiting examples of RNA-guided nucleases include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1 (or Cas12a), homologs thereof, or modified versions thereof. In an aspect, the RNA-guided nuclease is Cas9. In an aspect, the RNA-guided nuclease is Cpf1. In an aspect, the RNA-guided nuclease comprises a N and/or C-terminal nuclear localization sequences (NLS).

Description

The present disclosure provides triple stacked combinations of transgenes and/or mutations or edits in corn plants, plant parts, etc., comprising a first transgene that encodes one or more CONTANS (CO) or CONSTANS-like (COL) polypeptides, such as *Physcomitrella patens* CONSTANS-like 1 (PpCOL1), and a second transgene that encodes one or more MADS-box polypeptide, such as maize ZMM19 polypeptide, in addition to a reduction in the expression level of one or more GA20 and/or GA3 oxidase genes through suppression, mutation and/or editing of the GA oxidase genes, wherein the corn plants have a semi-dwarf or short stature phenotype and one or more improved traits related to yield, lodging resistance, and/or stress tolerance. The present disclosure also provides a stacked combination of transgenes in corn plants, plant parts, etc., comprising a first transgene that encodes one or more CONTANS (CO) or CONSTANS-like (COL) polypeptides, such as *Physcomitrella patens* CONSTANS-like 1 (PpCOL1), and a second transgene that encodes one or more MADS-box polypeptide, such as maize ZMM19 polypeptide.

As described in co-pending PCT Application No. PCT/US2017/047405, the entire contents and disclosure of which are incorporated herein by reference, reducing the level of active GAs in corn or other cereal plants, such as through suppression, mutation or editing of one or more GA20 and/or GA3 oxidase genes, can result in a semi-dwarf phenotype with improved agronomic traits, such as lodging resistance and/or increased yield. However, it is proposed herein that lower active GA levels can be combined with a first expression cassette or transgene encoding a CONTANS (CO) or CONSTANS-like (COL) protein, such as PpCOL1, and a second expression cassette or transgene encoding a MADS-box polypeptide, such as maize ZMM19 polypeptide, a to produce a semi-dwarf corn plant having positive ear traits leading to increased yield, thus providing greater agronomic benefits than either CO/COL expression, MADS-box expression, or lower active GA levels alone.

Gibberellins (gibberellic acids or GAs) are plant hormones that regulate a number of major plant growth and developmental processes. Manipulation of GA levels in semi-dwarf wheat, rice and sorghum plant varieties led to increased yield and reduced lodging in these cereal crops during the $20^{th}$ century, which was largely responsible for the Green Revolution. However, successful yield gains in other cereal crops, such as corn, have not been realized through manipulation of the GA pathway. Corn or maize is unique among the grain-producing grasses in that it forms separate male (tassel) and female (ear) inflorescences, and mutations in the GA pathway in corn have been shown to negatively impact reproductive development. Indeed, some mutations in the GA pathway genes in corn have been associated with various off-types that are incompatible with yield, which has led researchers away from finding semi-dwarf, high-yielding corn varieties via manipulation of the GA pathway.

Despite these prior difficulties in achieving higher grain yields in corn through manipulation of the GA pathway, co-pending PCT Application No. PCT/US2017/047405 describes a way to manipulate active GA levels in corn plants in a manner that reduces overall plant height and stem internode length, and increases resistance to lodging, but does not cause the reproductive off-types previously associated with mutations of the GA pathway in corn. Further evidence indicates that these short stature or semi-dwarf corn plants with reduced GA levels can also have one or more additional yield and/or stress tolerance traits, including increased stem diameter, reduced green snap, deeper roots, increased leaf area, earlier canopy closure, higher stomatal conductance, lower ear height, increased foliar water content, improved drought tolerance, increased nitrogen use efficiency, increased water use efficiency, reduced anthocyanin content and area in leaves under normal or nitrogen or water limiting stress conditions, increased ear weight, increased kernel number, increased kernel weight, increased yield, and/or increased harvest index.

Active or bioactive gibberellic acids (i.e., "active gibberellins" or "active GAs") are known in the art for a given plant species, as distinguished from inactive GAs. For example, active GAs in corn and higher plants include the following: GA1, GA3, GA4, and GA7. Thus, an "active GA-producing tissue" is a plant tissue that produces one or more active GAs.

Certain biosynthetic enzymes (e.g., GA20 oxidase and GA3 oxidase) and catabolic enzymes (e.g., GA2 oxidase) in the GA pathway participate in GA synthesis and degradation, respectively, to affect active GA levels in plant tissues. Thus, in addition to suppression of certain GA20 oxidase genes, it is further proposed that suppression of a GA3 oxidase gene in a constitutive or tissue-specific or tissue-preferred manner can also produce corn plants having a short stature phenotype and increased lodging resistance, with possible increased yield, but without off-types in the ear.

Without being bound by theory, it is proposed that incomplete suppression of GA20 or GA3 oxidase gene(s) and/or targeting of a subset of one or more GA oxidase gene(s) can be effective in achieving a short stature, semi-dwarf phenotype with increased resistance to lodging, but without reproductive off-types in the ear. Without being limited by theory, restricting the suppression of GA20 and/or GA3 oxidase gene(s) to certain active GA-producing tissues, such as the vascular and/or leaf tissues of the plant, can be sufficient to produce a short-stature plant with increased lodging resistance, but without significant off-types in reproductive tissues. Expression of a GA20 or GA3 oxidase suppression element in a tissue-specific or tissue-preferred manner can be sufficient and effective at producing plants with the short stature phenotype, while avoiding potential off-types in reproductive tissues that were previously observed with GA mutants in corn (e.g., by avoiding or limiting the suppression of the GA20 oxidase gene(s) in those reproductive tissues). For example, GA20 and/or GA3 oxidase gene(s) can be targeted for suppression using a vascular promoter, such as a rice tungro bacilliform virus (RTBV) promoter, that drives expression in vascular tissues of plants. The expression pattern of the RTBV promoter is enriched in vascular tissues of corn plants relative to non-vascular tissues, which is sufficient to produce a semi-dwarf phenotype in corn plants when operably linked to a suppression element targeting GA20 and/or GA3 oxidase gene(s). Lowering of active GA levels in tissue(s) of a corn plant that produce active GAs can reduce plant height and increase lodging resistance, and off-types can be avoided in those plants if active GA levels are not also significantly impacted or lowered in reproductive tissues, such as the developing female organ or ear of the plant. If active GA levels could be reduced in the stalk, stem, or internode(s) of corn or cereal plants without significantly affecting GA levels in reproductive tissues (e.g., the female or male reproductive organs or inflorescences), then corn or cereal plants having reduced plant height and increased lodging resistance could be created without off-types in the reproductive tissues of the plant.

Without being limited by theory, it is further proposed that short stature, semi-dwarf phenotypes in corn plants can result from a sufficient level of expression of a suppression construct targeting certain GA oxidase gene(s) in active GA-producing tissue(s) of the plant. For targeted suppression of certain GA20 oxidase genes in corn, restricting the pattern of expression to avoid reproductive ear tissues may not be necessary to avoid reproductive off-types in the developing ear. However, expression of a GA20 oxidase suppression construct at low levels, and/or in a limited number of plant tissues, can be insufficient to cause a significant short stature, semi-dwarf phenotype. Given that the observed semi-dwarf phenotype with targeted GA20 oxidase suppression is the result of shortening the stem internodes of the plant, it was surprisingly found that suppression of GA20 oxidase genes in at least some stem tissues was not sufficient to cause shortening of the internodes and reduced plant height. Without being bound by theory, it is proposed that suppression of certain GA oxidase gene(s) in tissue(s) and/or cell(s) of the plant where active GAs are produced, and not necessarily in stem or internode tissue(s), can be sufficient to produce semi-dwarf plants, even though the short stature trait is due to shortening of the stem internodes. Given that GAs can migrate through the vasculature of the plant, manipulating GA oxidase genes in plant tissue(s) where active GAs are produced can result in a short stature, semi-dwarf plant, even though this can be largely achieved by suppressing the level of active GAs produced in non-stem tissues (i.e., away from the site of action in the stem where reduced internode elongation leads to the semi-dwarf phenotype). Indeed, suppression of certain GA20 oxidase genes in leaf tissues causes a moderate semi-dwarf phenotype in corn plants. Given that expression of a GA20 oxidase suppression construct with several different "stem" promoters did not produce the semi-dwarf phenotype in corn, it is noteworthy that expression of the same GA20 oxidase suppression construct with a vascular promoter was effective at consistently producing the semi-dwarf phenotype with a high degree of penetrance across events and germplasms. A semi-dwarf phenotype was also observed with expression of the same GA20 oxidase suppression construct using other vascular promoters and with various constitutive promoters without any observable off-types.

By targeting a subset of one or more endogenous GA3 or GA20 oxidase genes for suppression within a plant, a more pervasive pattern of expression (e.g., with a constitutive promoter) can be used to produce semi-dwarf plants without significant reproductive off-types and/or other undesirable traits in the plant, even with expression of the suppression construct in reproductive tissue(s). Indeed, suppression elements and constructs are provided herein that selectively target the GA20 oxidase_3 and/or GA20 oxidase_5 genes for suppression, which can be operably linked to a vascular, leaf and/or constitutive promoter.

Thus, recombinant DNA constructs and modified corn plants are provided herein comprising a GA20 or GA3 oxidase suppression element or sequence operably linked to a plant expressible promoter, which can be a constitutive or tissue-specific or tissue-preferred promoter. Such a tissue-specific or tissue-preferred promoter can drive expression of its associated GA oxidase suppression element or sequence in one or more active GA-producing tissue(s) of the plant to suppress or reduce the level of active GAs produced in those tissue(s). Such a tissue-specific or tissue-preferred promoter can drive expression of its associated GA oxidase suppression construct or transgene during one or more vegetative stage(s) of development. Such a tissue-specific or tissue-preferred promoter can also have little or no expression in one or more cell(s) or tissue(s) of the developing female organ or ear of the plant to avoid the possibility of off-types in those reproductive tissues. According to an aspect, the tissue-specific or tissue-preferred promoter is a vascular promoter, such as the RTBV promoter. The sequence of the RTBV promoter is provided herein as SEQ ID NO: 65, and a truncated version of the RTBV promoter is further provided herein as SEQ ID NO: 66. However, other types of tissue-specific or tissue preferred promoters can potentially be used for GA3 oxidase suppression in active GA-producing tissues of a corn or cereal plant to produce a semi-dwarf phenotype without significant off-types. As introduced above, instead of suppressing one or more GA oxidase gene(s), active GA levels can also be reduced in a corn plant by mutation or editing of one or more GA20 and/or GA3 oxidase gene(s).

Corn has a family of at least nine GA20 oxidase genes that includes GA20 oxidase_1, GA20 oxidase_2, GA20 oxidase_3, GA20 oxidase_4, GA20 oxidase_5, GA20 oxidase_6, GA20 oxidase_7, GA20 oxidase_8, and GA20 oxidase_9. However, there are only two GA3 oxidases in corn, GA3 oxidase_1 and GA3 oxidase_2. The DNA and protein sequences by SEQ ID NOs for each of these GA20 oxidase genes are provided in Table 1, and the DNA and protein sequences by SEQ ID NOs for each of these GA3 oxidase genes are provided in Table 2.

TABLE 1

DNA and protein sequences by sequence identifier for GA20 oxidase genes in corn.

| GA20 oxidase Gene | cDNA | Coding Sequence (CDS) | Protein |
|---|---|---|---|
| GA20 oxidase_1 | SEQ ID NO: 1 | SEQ ID NO: 2 | SEQ ID NO: 3 |
| GA20 oxidase_2 | SEQ ID NO: 4 | SEQ ID NO: 5 | SEQ ID NO: 6 |
| GA20 oxidase_3 | SEQ ID NO: 7 | SEQ ID NO: 8 | SEQ ID NO: 9 |
| GA20 oxidase_4 | SEQ ID NO: 10 | SEQ ID NO: 11 | SEQ ID NO: 12 |
| GA20 oxidase_5 | SEQ ID NO: 13 | SEQ ID NO: 14 | SEQ ID NO: 15 |
| GA20 oxidase_6 | SEQ ID NO: 16 | SEQ ID NO: 17 | SEQ ID NO: 18 |
| GA20 oxidase_7 | SEQ ID NO: 19 | SEQ ID NO: 20 | SEQ ID NO: 21 |

TABLE 1-continued

DNA and protein sequences by sequence identifier for GA20 oxidase genes in corn.

| GA20 oxidase Gene | cDNA | Coding Sequence (CDS) | Protein |
|---|---|---|---|
| GA20 oxidase_8 | SEQ ID NO: 22 | SEQ ID NO: 23 | SEQ ID NO: 24 |
| GA20 oxidase_9 | SEQ ID NO: 25 | SEQ ID NO: 26 | SEQ ID NO: 27 |

TABLE 2

DNA and protein sequences by sequence identifier for GA3 oxidase genes in corn.

| GA3 oxidase Gene | cDNA | Coding Sequence (CDS) | Protein |
|---|---|---|---|
| GA3 oxidase_1 | SEQ ID NO: 28 | SEQ ID NO: 29 | SEQ ID NO: 30 |
| GA3 oxidase_2 | SEQ ID NO: 31 | SEQ ID NO: 32 | SEQ ID NO: 33 |

In addition to lowering active GA levels in corn plants through suppression, mutation or editing of GA oxidase gene(s), such corn plants as provided herein can further comprise an ectopically expressed CONSTANS (CO) or CONSTANS-like (COL) transgene. CONSTANS (CO) and its paralogous CONSTANS-like (COL) polypeptides are transcriptional regulators of the photoperiodic control of flowering in plants. In *Arabidopsis*, the CO gene, when mutated, delayed the flowering under long days, which is the inductive condition for flowering in this species. See Putterill et al., "The CO gene of *Arabidopsis* promotes flowering and encodes a protein showing similarities to zinc finger transcription factors," *Cell*, 80: 847-857 (1995). While not being limited by any scientific theory, CO protein expression is believed to be modulated by the circadian clock and day length to control flowering. See Suarez-Lopez et al., "CONSTANS mediates between the circadian clock and the control of flowering in *Arabidopsis*," *Nature*, 410: 1116-1120 (2001).

CO and COL are both zinc-finger transcription factors with characteristic domains and are found in monocot and dicot plant species. The N-terminal part of CO and COL proteins typically contain one or two tandem Zn finger domain(s), which are also called B-boxes involved in protein-protein interaction, and a C-terminal CCT (CO, CO-like, TOC1) domain, which can also include a nuclear import signal. See Khanna et al., "The *Arabidopsis* B-box zinc finger family," *Plant Cell*, 21:3416-3420 (2009); see also Robson et al., "Functional importance of conserved domains in the flowering-time gene CONSTANS demonstrated by analysis of mutant alleles and transgenic plants," *Plant J.*, 28:619-631 (2001). In addition to one or two B-boxes and the CCT domain, the CO and COL proteins can also contain a conserved six-amino acid motif (G-I/V-V-P-S/T-F) in their C-termini. See Datta et al., "*Arabidopsis* CONSTANS-LIKE3 is a positive regulator of red light signaling and root growth," *Plant Cell*, 18: 70-84 (2006).

*Physcomitrella patens* CONSTANS-like 1 (PpCOL1) is a zinc finger transcription factor derived from the *Physcomitrella patens* moss species. The expression of PpCOL1 is shown to be photoperiodically regulated in this moss species, suggesting a role for PpCOL1 in the photoperiodic control of reproduction. See Shimizu et al., "Photoperiod-regulated expression of the PpCOL1 gene encoding a homolog of CO/COL protein in the moss *Physcomitrella patens,"*. *Biochem. Biophys. Res. Commun.,* 324:1296-1301 (2004). Transgenic expression of PpCOL1 in corn plants has been shown to improve drought, salt, and/or cold tolerance. See U.S. Pat. No. 7,439,417. Transgenic expression of the PpCOL1 gene in corn plants also improves ear traits or metrics, such as single kernel weight, ear area, ear size, ear weight, and grain yield estimate.

The CONSTANS (CO) or CONSTANS-like (COL) transgene can comprise a coding sequence of any known CO or COL gene expected to have a similar function to PpCOL1. The CO/COL transgene can be a Group I, Group II, or Group III CONSTANS (CO) or CONSTANS-like (COL) gene. See, e.g., Cai, D et al., "Identification and characterization of CONSTANS-like (COL) gene family in upland cotton (*Gossypium hirsutum*)", PLOS ONE 12(6): e0179038, the entire contents and disclosure of which are incorporated by reference. The CO/COL transgene can comprise one or two B-box domain(s), a CCT domain, and possibly an additional VP motif and/or a diverged zinc-finger. See also, e.g., Khanna et al., "The *Arabidopsis* B-Box Zinc Finger Family," *Plant Cell* 21(11): 3416-3420 (2009), the entire contents and disclosure of which are incorporated by reference.

In an aspect, a CO or COL polypeptide of the present disclosure is a *Physcomitrella patens* COL (PpCOL) polypeptide or homologs, orthologs, and/or paralogs thereof. In an aspect, a CO or COL polynucleotide provided herein comprises an amino acid sequence comprising SEQ ID NOs: 168, and homologs, orthologs, and paralogs thereof. In another aspect, a CO or COL polynucleotide provided herein comprises an amino acid sequence selected from the group consisting of SEQ ID NOs: 182-403 (single B-box domain) and 404-458 (two B-box domains), and homologs, orthologs, and paralogs thereof.

Co-pending application PCT/US2019/018130 describes modified corn plants comprising a transgene encoding one or more CO or COL polypeptides and a reduced expression of one or more GA20 or GA3 oxidase genes, which is incorporated herein by reference in its entirety.

In addition to lowering active GA levels in corn plants through suppression, mutation or editing of GA oxidase gene(s), such corn plants as provided herein may further comprise an ectopically expressed transgene expressing one or more MADS-box polypeptides.

MADS-box polypeptides typically have transcription factor activity and are involved in controlling all major aspects of the life of land plants. The MADS-box polypeptides, encoded by the MADS box gene, are characterized by the highly conserved DNA-binding MADS domain (about 58 amino acids), and is named after MCMI, AGAMOUS, DEFICIENS and SRF (serum response factor) proteins.

Without being bound by any theory, MADS-box polypeptides can be classified into type I and type II subfamilies. Type I polypeptides do not have distinct conserved domains other than the SRF-like MADS domain. Type II polypeptides are commonly referred to as MIKC-type polypeptides after their domain structure: MADS domain, intervening (I) domain, keratin-like (K) domain, and carboxyl-terminal (C) domains. Type I polypeptides do not have K domain. See Gramzow and Theissen, *Genome Biol.,* 11: 214 (2010), the content and disclosure of which are incorporated by reference.

Without being bound by any theory, MADS-box polypeptides can bind to DNA as dimers and/or multimeric complexes and can thus regulate target gene by direct transcriptional activation or repression. Dimers of MADS-box polypeptides can bind to CArG-boxes, i.e., stretches of DNA with a consensus sequence of 5'-CC[A/T]$_6$GG-3', or very similar sequences thereof. The number of CArG-boxes in genomes is enormous, and different MADS-box polypeptides can recognize different sets of target genes, and thus play a universal role in plant development and/or growth.

Without being bound by any theory, in plants, type II MADS-box polypeptides are suggested to be able to 1) control various aspects of sporophyte development, 2) determine flowering time, 3) specify floral meristem identity, floral organ identity, fruit formation, and seed pigmentation, and/or 4) play generally critical roles in gametophyte development.

As used herein, a MADS-box polynucleotide refers to a polynucleotide, gene or coding sequence encoding a polypeptide containing at least one SRF-TF MADS-box Pfam domain and a K-box Pfam domain, and encompasses any variants (e.g., polymorphisms), isoforms, homologs, orthologs, and/or paralogs thereof. On the sequence level, the SRF-TF MADS-box domain is located on the N-terminal side of the K-box domain, or stated differently, the K-box domain is located on the C-terminal side of the SRF-TF MADS-box domain.

In an aspect, a MADS-box polypeptide of the present disclosure is a maize ZMM19 polypeptide or homologs, orthologs, and/or paralogs thereof. In an aspect, a MADS-box polypeptide of the present disclosure comprises an amino acid sequence comprising SEQ ID NO: 176, or a functional fragment thereof. In another aspect, a MADS-box polynucleotide provided herein comprises an amino acid sequence selected from the group consisting of SEQ ID NOs: 459-483, and any homologs, orthologs, and paralogs thereof.

Co-pending application PCT/US2019/018136 describes modified corn plants comprising a transgene encoding one or more MADS-box polypeptides and a reduced expression of one or more GA20 or GA3 oxidase genes, which is incorporated herein by reference in its entirety.

According to an aspect, a modified corn plant or plant part is provided comprising (1) a first recombinant expression cassette comprising a transcribable DNA sequence encoding a non-coding RNA for suppression of one or more GA20 oxidase genes and/or one or more GA3 oxidase genes, (2) a second expression cassette comprising a first DNA sequence encoding a CONSTANS (CO) or CONSTANS-like (COL) polypeptide, and (3) a third recombinant expression cassette comprising a second DNA sequence encoding a MADS-box polypeptide. Alternatively, a modified corn plant or plant part is provided comprising (1) one or more mutated or edited GA20 oxidase genes and/or one or more mutated or edited GA3 oxidase genes, (2) a first recombinant expression cassette comprising a encoding sequence for a CONSTANS (CO) or CONSTANS-like (COL) polypeptide, and (3) a second recombinant expression cassette comprising a encoding sequence for a MADS-box polypeptide.

According to another aspect, a modified corn plant or a plant part thereof is provided comprising 1) a first recombinant expression cassette (or a construct) comprising a transcribable DNA sequence encoding a non-coding RNA for suppression of one or more gibberellic acid 20 (GA20) oxidase genes and/or one or more gibberellic acid 3 (GA3) oxidase genes, 2) a second recombinant expression cassette (or a construct) comprising a encoding sequence for a CONSTANS (CO) or CONSTANS-like (COL) polypeptide, and 3) a third recombinant expression cassette (or a construct) comprising a encoding sequence for a MADS-box polypeptide.

According to another aspect, a plurality of modified corn plants in a field, each modified corn plant comprising 1) a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes, 2) a second recombinant expression cassette comprising a first DNA sequence encoding a CONSTANS (CO) or CONSTANS-like (COL) polypeptide, and 3) a third recombinant expression cassette comprising a second DNA sequence encoding a MADS-box polypeptide. In an aspect, the modified corn plants have increased yield relative to control corn plants. In another aspect, the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

Such modified corn plants can have semi-dwarf plant height in addition to one or more improved yield-related traits as described further herein, relative to control corn plant(s) that do not have the first, second, and third expression cassettes or the combination of CO/COL and MADS-box transgenes and edited/mutated GA oxidase gene(s). Modified corn plants comprising a combination of the first, second, and third expression cassettes, or a combination of an expression cassette comprising a CO or COL and MADS-box transgene and one or more mutated or edited GA oxidase genes, can each be referred to as a "triple stack" or "triple stacked" combination. Such triple stacked combinations for the reduction of active GA levels and expression of a CO/COL and a MADS-box transgenes can be brought together in the same corn plant, or population of corn plants, by (1) crossing a first plant comprising a GA oxidase suppression element(s), edit(s) and/or mutation(s) to a second plant comprising a CO/COL and a MADS-box transgenes; (2) crossing a first plant comprising a CO/COL transgene to a second plant comprising a GA oxidase suppression element(s), edit(s) and/or mutation(s) and a MADS-box transgene; (3) crossing a first plant comprising MADS-box transgene to a second plant comprising a GA oxidase suppression element(s), edit(s) and/or mutation(s) and a CO/COL transgene; (4) co-transformation of a plant or plant part with a GA oxidase suppression element(s), a CO/COL transgene, and a MADS-box transgene, (5) transformation of a plant or plant part already having a GA oxidase suppression element(s), edit(s) and/or mutation(s) and a MADS-box transgene with a CO/COL transgene, (6) transformation of a plant or plant part already having a CO/COL transgene and a MADS-box transgene with a GA oxidase suppression element(s), (7) transformation of a plant or plant part already having a GA oxidase suppression element(s), edit(s) and/or mutation(s) and a CO/COL transgene with a MADS-box transgene; (8) editing or mutating a GA oxidase gene(s) in a plant or plant part already having a CO/COL transgene and a MADS-box transgene, each of which can be followed by further crosses to obtain a desired genotype, plant parts can be regenerated, grown or developed into plants, and plant parts can be taken from any of the foregoing plants.

As provided above, a corn plant or plant part can comprise a first expression cassette comprising a first sequence encoding a non-coding RNA molecule that targets one or more GA20 or GA3 oxidase gene(s) for suppression. In an aspect, the non-coding RNA molecule can target one or more GA20 oxidase gene(s) for suppression, such as a GA20 oxidase_3 gene, a GA20 oxidase_4 gene, a GA20 oxidase_5 gene, or any combination thereof. According to an aspect, the first expression cassette comprises a first transcribable DNA sequence encoding a non-coding RNA targeting a GA20 oxidase_3 gene for suppression. According to another aspect, the first expression cassette comprises a first transcribable DNA sequence encoding a non-coding RNA targeting a GA20 oxidase_5 gene for suppression. According to another aspect, the first expression cassette comprises a first transcribable DNA sequence encoding a non-coding RNA that targets both the GA20 oxidase_3 gene and the GA20 oxidase_5 gene for suppression. In addition to targeting a mature mRNA sequence (including either or both of the untranslated or exonic sequences), a non-coding RNA molecule can also target the intronic sequences of a GA20 oxidase gene or transcript.

A genomic DNA sequence of GA20 oxidase_3 is provided in SEQ ID NO: 34, and the genomic DNA sequence of GA20 oxidase 5 is provided in SEQ ID NO: 35. For the GA20 oxidase_3 gene, SEQ ID NO: 34 provides 3000 nucleotides upstream of the GA20 oxidase_3 5'-UTR; nucleotides 3001-3096 correspond to the 5'-UTR; nucleotides 3097-3665 correspond to the first exon; nucleotides 3666-3775 correspond to the first intron; nucleotides 3776-4097 correspond to the second exon; nucleotides 4098-5314 correspond to the second intron; nucleotides 5315-5584 correspond to the third exon; and nucleotides 5585-5800 correspond to the 3'-UTR. SEQ ID NO: 34 also provides 3000 nucleotides downstream of the end of the 3'-UTR (nucleotides 5801-8800). For the GA20 oxidase_5 gene, SEQ ID NO: 35 provides 3000 nucleotides upstream of the GA20 oxidase 5 start codon (nucleotides 1-3000); nucleotides 3001-3791 correspond to the first exon; nucleotides 3792-3906 correspond to the first intron; nucleotides 3907-4475 correspond to the second exon; nucleotides 4476-5197 correspond to the second intron; nucleotides 5198-5473 correspond to the third exon; and nucleotides 5474-5859 correspond to the 3'-UTR. SEQ ID NO: 35 also provides 3000 nucleotides downstream of the end of the 3'-UTR (nucleotides 5860-8859).

A genomic DNA sequence of GA20 oxidase_4 is provided in SEQ ID NO: 38. For the GA oxidase_4 gene, SEQ ID NO: 38 provides nucleotides 1-1416 upstream of the 5'-UTR; nucleotides 1417-1543 of SEQ ID NO: 38 correspond to the 5'-UTR; nucleotides 1544-1995 of SEQ ID NO: 38 correspond to the first exon; nucleotides 1996-2083 of SEQ ID NO: 38 correspond to the first intron; nucleotides 2084-2411 of SEQ ID NO: 38 correspond to the second exon; nucleotides 2412-2516 of SEQ ID NO: 38 correspond to the second intron; nucleotides 2517-2852 of SEQ ID NO: 38 correspond to the third exon; nucleotides 2853-3066 of SEQ ID NO: 38 correspond to the 3'-UTR; and nucleotides 3067-4465 of SEQ ID NO: 38 corresponds to genomic sequence downstream of to the 3'-UTR.

For suppression of a GA20 oxidase 3 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 7 and 8.

For suppression of a GA20 oxidase 4 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 10 and 11.

For suppression of a GA20 oxidase 5 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 13 and 14.

For suppression of a GA20 oxidase 3 gene and a GA20 oxidase 5 gene, a transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 7 and 8; and at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 13 and 14.

For suppression of a GA20 oxidase_3 gene and a GA20 oxidase_5 gene, a transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 7 and 8; and the transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 13 and 14.

For suppression of a GA20 oxidase 3 gene and a GA20 oxidase 5 gene, a transcribable DNA sequence encodes a non-coding RNA sequence, wherein the non-coding RNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or similar to SEQ ID NO: 9 or 15.

For suppression of a GA20 oxidase 3 gene and a GA20 oxidase 5 gene, a transcribable DNA sequence encodes a non-coding RNA sequence, wherein the non-coding RNA sequence comprises a sequence that is (i) at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a first mRNA molecule encoding a first endogenous GA oxidase protein in a corn plant or plant cell, the first endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or similar to SEQ ID NO: 9; and (ii) at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a second mRNA molecule encoding a second endogenous GA oxidase protein in a corn plant or plant cell, the second endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or similar to SEQ ID NO: 15.

In an aspect, a non-coding RNA molecule encoded by a transcribable DNA sequence comprises (i) a sequence that is at least 95%, at least 96%, at least 97%, at least 98%, at least 99%, at least 99.5%, or 100% complementary to SEQ ID NO: 39, 41, 43 or 45, and/or (ii) a sequence or suppression element encoding a non-coding RNA molecule comprising a sequence that is at least 95%, at least 96%, at least 97%, at least 98%, at least 99%, at least 99.5%, or 100% identical to SEQ ID NO: 40, 42, 44 or 46. According to an aspect, the non-coding RNA molecule encoded by a transcribable DNA sequence can comprise a sequence with one or more mismatches, such as 1, 2, 3, 4, 5 or more complementary mismatches, relative to the sequence of a target or recognition site of a targeted GA20 oxidase gene mRNA, such as a sequence that is nearly complementary to SEQ ID NO: 40 but with one or more complementary mismatches relative to SEQ ID NO: 40. According to a particular aspect, the non-coding RNA molecule encoded by the transcribable DNA sequence comprises a sequence that is 100% identical to SEQ ID NO: 40, which is 100% complementary to a target sequence within the cDNA and coding sequences of the GA20 oxidase_3 (i.e., SEQ ID NOs: 7 and 8, respectively), and/or to a corresponding sequence of a mRNA encoded by an endogenous GA20 oxidase_3 gene. However, the sequence of anon-coding RNA molecule encoded by a transcribable DNA sequence that is 100% identical to SEQ ID NO: 40, 42, 44 or 46 may not be perfectly complementary to a target sequence within the cDNA and coding sequences of the GA20 oxidase_5 gene (i.e., SEQ ID NOs: 13 and 14, respectively), and/or to a corresponding sequence of a mRNA encoded by an endogenous GA20 oxidase_5 gene. For example, the closest complementary match between the non-coding RNA molecule or miRNA sequence in SEQ ID NO: 40 and the cDNA and coding sequences of the GA20 oxidase_5 gene can include one mismatch at the first position of SEQ ID NO: 39 (i.e., the "C" at the first position of SEQ ID NO: 39 is replaced with a "G"; i.e., GTCCATCATGCGGTGCAACTA). However, the non-coding RNA molecule or miRNA sequence in SEQ ID NO: 40 can still bind and hybridize to the mRNA encoded by the endogenous GA20 oxidase_5 gene despite this slight mismatch.

For suppression of a GA20 oxidase_1 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 1 and 2.

For suppression of a GA20 oxidase_2 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 4 and 5.

For suppression of a GA2 oxidase 6, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 16 and 17.

For suppression of a GA20 oxidase 7 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 19 and 20.

For suppression of a GA20 oxidase_8 gene, a first transcribable DNA sequence comprises a sequence that is at least at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 22 and 23.

For suppression of a GA20 oxidase_9 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 25 and 26.

A non-coding RNA can target an intron or untranslated region (UTR) sequence of a GA20 oxidase gene instead of, or in addition to, an exon, intron, 5' UTR or 3' UTR of the GA20 oxidase gene. Thus, a non-coding RNA targeting the GA20 oxidase_3 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 34, and/or of nucleotides 3666-3775 or 4098-5314 of SEQ ID NO: 34.

In another aspect, a non-coding RNA molecule targeting the GA20 oxidase_5 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 35, and/or of nucleotides 3792-3906 or 4476-5197 of SEQ ID NO: 35.

In another aspect, a non-coding RNA molecule targeting the GA20 oxidase_4 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 38, and/or of nucleotides 1996-2083 or 2412-2516 of SEQ ID NO: 38.

In another aspect, a first expression cassette comprises a first transcribable DNA sequence encoding a non-coding RNA targeting a GA3 oxidase gene(s) for suppression in corn, such as a GA3 oxidase_1 gene or a GA3 oxidase_2 gene. In another aspect, a first transcribable DNA sequence encoding a non-coding RNA targets both the GA3 oxidase_1 gene and the GA3 oxidase_2 gene for suppression. In addition to targeting a mature mRNA sequence (including either or both of the untranslated or exonic sequences), a non-coding RNA molecule can also target the intronic sequences of a GA3 oxidase gene or transcript.

The genomic DNA sequence of GA3 oxidase_1 is provided in SEQ ID NO: 36, and the genomic DNA sequence of GA3 oxidase_2 is provided in SEQ ID NO: 37. For the GA3 oxidase_1 gene, nucleotides 1-29 of SEQ ID NO: 36 correspond to the 5'-UTR; nucleotides 30-514 of SEQ ID NO: 36 correspond to the first exon; nucleotides 515-879 of SEQ ID NO: 36 correspond to the first intron; nucleotides 880-1038 of SEQ ID NO: 36 correspond to the second exon; nucleotides 1039-1158 of SEQ ID NO: 36 correspond to the second intron; nucleotides 1159-1663 of SEQ ID NO: 36 correspond to the third exon; and nucleotides 1664-1788 of SEQ ID NO: 36 correspond to the 3'-UTR. For the GA3 oxidase_2 gene, nucleotides 1-38 of SEQ ID NO: 37 correspond to the 5-UTR; nucleotides 39-532 of SEQ ID NO: 37 correspond to the first exon; nucleotides 533-692 of SEQ ID NO: 37 correspond to the first intron; nucleotides 693-851 of SEQ ID NO: 37 correspond to the second exon; nucleotides 852-982 of SEQ ID NO: 37 correspond to the second intron; nucleotides 983-1445 of SEQ ID NO: 37 correspond to the third exon; and nucleotides 1446-1698 of SEQ ID NO: 37 correspond to the 3'-UTR.

For suppression of a GA3 oxidase 1 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 28 and 29.

In an aspect, a non-coding RNA molecule can target an intron or untranslated region (UTR) sequence of a GA3 oxidase gene instead of, or in addition to, an exon, intron, 5' UTR or 3' UTR of the GA oxidase gene. Thus, a non-coding RNA molecule targeting the GA3 oxidase_1 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 36, and/or of nucleotides 515-879 or 1039-1158 of SEQ ID NO: 36.

For suppression of a GA3 oxidase 2 gene, a first transcribable DNA sequence comprises a sequence that is at least at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 31 and 32.

In an aspect, a non-coding RNA molecule targeting the GA3 oxidase_2 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 37, and/or of nucleotides 533-692 or 852-982 of SEQ ID NO: 37.

For suppression of a GA3 oxidase_1 gene and a GA3 oxidase_2 gene, a transcribable DNA sequence comprises a sequence that is (i) at least at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in one or both of SEQ ID NOs: 28 and/or 29; and (ii) at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in one or both of SEQ ID NOs: 31 and/or 32.

For suppression of a GA3 oxidase_1 gene and a GA3 oxidase_2 gene, a transcribable DNA sequence comprises a sequence that is at least at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 28 and/or 29; and the transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 31 and/or 32.

In an aspect, a transcribable DNA sequence for the suppression of a GA20 oxidase gene and/or a GA3 oxidase comprises a sequence selected from the group consisting of SEQ ID NOs: 47, 49, 51, 53, 55, 57, 59, 61, and 63. In another aspect, a transcribable DNA sequence for the suppression of a GA20 oxidase gene and/or a GA3 oxidase encodes a non-coding RNA sequence, wherein the non-coding RNA sequence comprises a sequence selected from the group consisting of SEQ ID NOs: 48, 50, 52, 54, 56, 58, 60, 62, and 64.

In an aspect, an expression cassette is provided comprising a second DNA sequence encoding a CO or COL polypeptide. In one aspect, the second DNA sequence encodes a protein that comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to an amino acid sequence of SEQ ID NO: 168. In another aspect, the second DNA sequence encodes a protein that comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to an amino acid sequence selected from the group consisting of SEQ ID NOs: 182-403. In another aspect, the second DNA sequence encodes a protein that comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to an amino acid sequence selected from the group consisting of SEQ ID NOs: 404-458. The second DNA sequence encoding a CO or COL polypeptide is operatively linked to a constitutive or tissue-specific promoter. In an aspect, such a tissue-specific promoter operably linked to a DNA sequence encoding a CO or COL polypeptide is a vascular promoter. In an aspect, such a tissue-specific promoter operably linked to a DNA sequence encoding a CO or COL polypeptide is a leaf promoter. In an aspect, such a tissue-specific promoter operably linked to a DNA sequence encoding a CO or COL polypeptide is a meristem promoter, such as a meristem-specific promoter or a meristem-preferred promoter. In another aspect, such a tissue-specific promoter operably linked to a DNA sequence encoding a CO or COL polypeptide is a kernel or seed promoter, such as a seed-preferred or seed-specific promoter. Examples of a meristem promoter, and a seed or kernel promoter are provided herein.

In an aspect, an expression cassette is provided comprising a second DNA sequence encoding PpCOL1. In another aspect, the second DNA sequence comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NO: 169. In another aspect, the second DNA sequence comprises a sequence encoding a polypeptide that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168, or a functional fragment thereof. The second DNA sequence encoding PpCOL1 polypeptide is operatively linked to a constitutive or tissue-specific promoter. In an aspect, such a tissue-specific promoter operably linked to a DNA sequence encoding PpCOL1 polypeptide is a vascular promoter. In an aspect, such a tissue-specific promoter operably linked to a DNA sequence encoding PpCOL1 polypeptide is a leaf promoter. In an aspect, such a tissue-specific promoter operably linked to a DNA sequence encoding PpCOL1 polypeptide is a meristem promoter, such as a meristem-specific promoter or a meristem-preferred promoter. In another aspect, such a tissue-specific promoter operably linked to a DNA sequence encoding PpCOL1 polypeptide is a kernel or seed promoter, such as a seed-preferred or seed-specific promoter. Examples of a meristem promoter, and a seed or kernel promoter are provided herein.

In an aspect, an expression cassette is provided comprising a third DNA sequence encoding a MADS-box polypeptide. In another aspect, the third DNA sequence encodes a protein that comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to an amino acid sequence selected from the group consisting of SEQ ID NOs: 459-483. The third DNA sequence encoding a MADS-box polypeptide is operatively linked to a constitutive or tissue-specific promoter. In an aspect, such a tissue-specific promoter operably linked to a DNA sequence encoding a MADS-box polypeptide is a vascular promoter. In an aspect, such a tissue-specific promoter operably linked to a DNA sequence encoding a MADS-box polypeptide is a root promoter. In an aspect, such a tissue-specific promoter operably linked to a DNA sequence encoding a MADS-box polypeptide is a meristem promoter, such as a meristem-specific promoter or a meristem-preferred promoter. In another aspect, such a tissue-specific promoter operably linked to a DNA sequence encoding a MADS-box polypeptide is a kernel or seed promoter, such as a seed-preferred or seed-specific promoter. Examples of a meristem promoter, and a seed or kernel promoter are provided herein.

In aspect, an expression cassette is provided comprising a third DNA sequence encoding maize ZMM19. In another aspect, the third DNA sequence comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NO: 177. In another aspect, the second DNA sequence comprises a sequence encoding a polypeptide that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176, or a functional fragment thereof. The third DNA sequence encoding maize ZMM19 polypeptide is operatively linked to a constitutive or tissue-specific promoter. In an aspect, such a tissue-specific promoter operably linked to a DNA sequence encoding maize ZMM19 polypeptide is a vascular promoter. In an aspect, such a tissue-specific promoter operably linked to a DNA sequence encoding maize ZMM19 polypeptide is a root promoter. In an aspect, such a tissue-specific promoter operably linked to a DNA sequence encoding maize ZMM19 polypeptide is a meristem promoter, such as a meristem-specific promoter or a meristem-preferred promoter. In another aspect, such a tissue-specific promoter operably linked to a DNA sequence encoding maize ZMM19 polypeptide is a kernel or seed promoter, such as a seed-preferred or seed-specific promoter. Examples of a meristem promoter, and a seed or kernel promoter are provided herein. In an aspect, a meristem promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or both of SEQ ID NOs: 484 and 485, or a functional portion thereof. In another aspect, a seed promoter or a kernel promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 486-491, or a functional portion thereof.

In an aspect, such a root promoter is an *Oryza sativa* Rcc3 gene promoter. In an aspect, such a root promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 178, or a functional portion thereof. In an aspect, such a seed or kernel promoter is from a maize putative embryo-specific (Esp) gene promoter.

In addition to targeting a mature mRNA sequence, a non-coding RNA molecule can instead target an intronic sequence of a GA oxidase gene or mRNA transcript, or a GA oxidase mRNA sequence overlapping coding and non-coding sequences. According to other aspects, a recombinant DNA molecule, vector or construct is provided comprising a transcribable DNA sequence encoding a non-coding RNA (precursor) molecule that is cleaved or processed into a mature non-coding RNA molecule that binds or hybridizes to a target mRNA in a plant cell, wherein the target mRNA molecule encodes a GA20 or GA3 oxidase protein, and wherein the transcribable DNA sequence is operably linked to a constitutive or tissue-specific or tissue-preferred promoter.

Any method known in the art for suppression of a target gene can be used to suppress GA oxidase gene(s) according to aspects of the present disclosure including expression of antisense RNAs, double stranded RNAs (dsRNAs) or inverted repeat RNA sequences, or via co-suppression or RNA interference (RNAi) through expression of small interfering RNAs (siRNAs), short hairpin RNAs (shRNAs), trans-acting siRNAs (ta-siRNAs), or micro RNAs (miRNAs). Furthermore, sense and/or antisense RNA molecules can be used that target the non-coding genomic sequences or regions within or near a gene to cause silencing of the gene. Accordingly, any of these methods can be used for the targeted suppression of an endogenous GA oxidase gene(s) in a tissue-specific or tissue-preferred manner. See. e.g., U.S. Patent Application Publication Nos. 2009/0070898, 2011/0296555, and 2011/0035839, the contents and disclosures of which are incorporated herein by reference.

In an aspect, an expression level(s) of one or more endogenous GA20 oxidase and/or GA3 oxidase gene(s) is/are reduced or eliminated in the modified corn plant, thereby suppressing the endogenous GA20 oxidase and/or GA3 oxidase gene(s).

According to an aspect, a modified or transgenic plant is provided having the expression level(s) of one or more GA20 oxidase gene(s) reduced in at least one plant tissue by at least 5%, at least 10%, at least 20%, at least 25%, at least 30%, at least 40%, at least 50%, at least 60%, at least 70%, at least 75%, at least 80%, at least 90%, or 100%, as compared to a control plant.

According to an aspect, a modified or transgenic plant is provided having the expression level(s) of one or more GA3 oxidase gene(s) reduced in at least one plant tissue by at least 5%, at least 10%, at least 20%, at least 25%, at least 30%, at least 40%, at least 50%, at least 60%, at least 70%, at least 75%, at least 80%, at least 90%, or 100%, as compared to a control plant.

According to an aspect, a modified or transgenic plant is provided having the expression level(s) of one or more GA20 oxidase gene(s) reduced in at least one plant tissue by 5%-20%, 5%-25%, 5%-30%, 5%-40%, 5%-50%, 5%-60%, 5%-70%, 5%-75%, 5%-80%, 5%-90%, 5%-100%, 75%-100%, 50%-100%, 50%-90%, 50%-75%, 25%-75%, 30%-80%, or 10%-75%, as compared to a control plant.

According to an aspect, a modified or transgenic plant is provided having the expression level(s) of one or more GA3 oxidase gene(s) reduced in at least one plant tissue by 5%-20%, 5%-25%, 5%-30%, 5%-40%, 5%-50%, 5%-60%, 5%-70%, 5%-75%, 5%-80%, 5%-90%, 5%-100%, 75%-100%, 50%-100%, 50%-90%, 50%-75%, 25%-75%, 30%-80%, or 10%-75%, as compared to a control plant.

According to an aspect, the at least one tissue of a modified or transgenic plant having a reduced expression level of a GA20 oxidase and/or GA3 oxidase gene(s) includes one or more active GA producing tissue(s) of the plant, such as the vascular and/or leaf tissue(s) of the plant, during one or more vegetative stage(s) of development.

In an aspect, the non-coding RNA is a precursor miRNA or siRNA capable of being processed or cleaved to form a mature miRNA or siRNA.

In an aspect, suppression of an endogenous GA20 oxidase gene or a GA3 oxidase gene is tissue-specific (e.g., only in leaf and/or vascular tissue). Suppression of a GA20 oxidase gene can be constitutive and/or vascular or leaf tissue specific or preferred. In other aspects, suppression of a GA20 oxidase gene or a GA3 oxidase gene is constitutive and not tissue-specific. According to an aspect, expression of an endogenous GA20 oxidase gene and/or a GA3 oxidase gene is reduced in one or more tissue types (e.g., in leaf and/or vascular tissue(s)) of a modified or transgenic plant as compared to the same tissue(s) of a control plant.

Engineered miRNAs can be useful for targeted gene suppression with increased specificity. See, e.g., Parizotto et al., *Genes Dev.* 18:2237-2242 (2004), and U.S. Patent Application Publication Nos. 2004/0053411, 2004/0268441, 2005/0144669, and 2005/0037988, the contents and disclosures of which are incorporated herein by reference. miR- NAs are non-protein coding RNAs. When a miRNA precursor molecule is cleaved, a mature miRNA is formed that is typically from about 19 to about 25 nucleotides in length (commonly from about 20 to about 24 nucleotides in length in plants), such as 19, 20, 21, 22, 23, 24, or 25 nucleotides in length, and has a sequence corresponding to the gene targeted for suppression and/or its complement. Mature miRNA hybridizes to target mRNA transcripts and guides the binding of a complex of proteins to the target transcripts, which can function to inhibit translation and/or result in degradation of the transcript, thus negatively regulating or suppressing expression of the targeted gene. miRNA precursors are also useful in plants for directing in-phase production of siRNAs, trans-acting siRNAs (ta-siRNAs), in a process that requires a RNA-dependent RNA polymerase to cause suppression of a target gene. See, e.g., Allen et al., *Cell*, 121:207-221 (2005), Vaucheret, *Science STKE*, 2005:pe43 (2005), and Yoshikawa et al. *Genes Dev.*, 19:2164-2175 (2005), the contents and disclosures of which are incorporated herein by reference.

Without being limited by any scientific theory, plant miRNAs regulate their target genes by recognizing and binding to a complementary or near-perfectly complementary sequence (miRNA recognition site) in the target mRNA transcript, followed by cleavage of the transcript by RNase III enzymes, such as ARGONAUTE1. In plants, certain mismatches between a given miRNA recognition site and the corresponding mature miRNA are typically not tolerated, particularly mismatched nucleotides at positions 10 and 11 of the mature miRNA. Positions within the mature miRNA are given in the 5' to 3' direction. Perfect complementarity between a given miRNA recognition site and the corresponding mature miRNA is usually required at positions 10 and 11 of the mature miRNA. See, for example, Franco-Zorrilla et al. (2007) *Nature Genetics*, 39:1033-1037; and Axtell et al. (2006) *Cell*, 127:565-577.

Many microRNA genes (MIR genes) have been identified and made publicly available in a database ("miRBase", available on line at microma.sanger.ac.uk/sequences; also see Griffiths-Jones et al. (2003) *Nucleic Acids Res.*, 31:439-441). MIR genes have been reported to occur in intergenic regions, both isolated and in clusters in the genome, but can also be located entirely or partially within introns of other genes (both protein-coding and non-protein-coding). For a review of miRNA biogenesis, see Kim (2005) *Nature Rev. Mol. Cell. Biol.*, 6:376-385. Transcription of MIR genes can be, at least in some cases, under promotional control of a MIR gene's own promoter. The primary transcript, termed a "pri-miRNA", can be quite large (several kilobases) and can be polycistronic, containing one or more pre-miRNAs (foldback structures containing a stem-loop arrangement that is processed to the mature miRNA) as well as the usual 5' "cap" and polyadenylated tail of an mRNA. See, for example, FIG. 1 in Kim (2005) *Nature Rev. Mol. Cell. Biol.*, 6:376-385.

Transgenic expression of miRNAs (whether a naturally occurring sequence or an artificial sequence) can be employed to regulate expression of the miRNA's target gene or genes. Recognition sites of miRNAs have been validated in all regions of a mRNA, including the 5' untranslated region, coding region, intron region, and 3' untranslated region, indicating that the position of the miRNA target or recognition site relative to the coding sequence may not necessarily affect suppression (see, e.g., Jones-Rhoades and Bartel (2004). *Mol. Cell*, 14:787-799, Rhoades et al. (2002) *Cell*, 110:513-520, Allen et al. (2004) *Nat. Genet.*, 36:1282-1290, Sunkar and Zhu (2004) Plant Cell, 16:2001-2019). miRNAs are important regulatory elements in eukaryotes, and transgenic suppression with miRNAs is a useful tool for manipulating biological pathways and responses. A description of native miRNAs, their precursors, recognition sites, and promoters is provided in U.S. Patent Application Publication No. 2006/0200878, the contents and disclosures of which are incorporated herein by reference.

Designing an artificial miRNA sequence can be achieved by substituting nucleotides in the stem region of a miRNA precursor with a sequence that is complementary to the intended target, as demonstrated, for example, by Zeng et al. (2002) *Mol. Cell*, 9:1327-1333. According to many aspects, the target can be a sequence of a GA20 oxidase gene or a GA3 oxidase gene. One non-limiting example of a general method for determining nucleotide changes in a native miRNA sequence to produce an engineered miRNA precursor for a target of interest includes the following steps: (a) selecting a unique target sequence of at least 18 nucleotides specific to the target gene, e.g., by using sequence alignment tools such as BLAST (see, for example, Altschul et al. (1990) *J. Mol. Biol.*, 215:403-410; Altschul et al. (1997) *Nucleic Acids Res.*, 25:3389-3402); cDNA and/or genomic DNA sequences can be used to identify target transcript orthologues and any potential matches to unrelated genes, thereby avoiding unintentional silencing or suppression of non-target sequences; (b) analyzing the target gene for undesirable sequences (e.g., matches to sequences from non-target species), and score each potential target sequence for GC content, Reynolds score (see Reynolds et al. (2004) *Nature Biotechnol.*, 22:326-330), and functional asymmetry characterized by a negative difference in free energy ("$\Delta\Delta G$") (see Khvorova et al. (2003) *Cell*, 115:209-216). Preferably, target sequences (e.g., 19-mers) can be selected that have all or most of the following characteristics: (1) a Reynolds score>4, (2) a GC content between about 40% to about 60%, (3) a negative $\Delta\Delta G$, (4) a terminal adenosine, (5) lack of a consecutive run of 4 or more of the same nucleotide; (6) a location near the 3' terminus of the target gene; (7) minimal differences from the miRNA precursor transcript. In an aspect, a non-coding RNA molecule used here to suppress a target gene (e.g., a GA20 or GA3 oxidase gene) is designed to have a target sequence exhibiting one or more, two or more, three or more, four or more, or five or more of the foregoing characteristics. Positions at every third nucleotide of a suppression element can be important in influencing RNAi efficacy; for example, an algorithm, "siExplorer" is publicly available at ma.chem.t.u-tokyo.ac.jp/siexplorer.htm (see Katoh and Suzuki (2007) *Nucleic Acids Res.*, 10.1093/nar/gkl1120); (c) determining a reverse complement of the selected target sequence (e.g., 19-mer) to use in making a modified mature miRNA. Relative to a 19-mer sequence, an additional nucleotide at position 20 can be matched to the selected target or recognition sequence, and the nucleotide at position 21 can be chosen to either be unpaired to prevent spreading of silencing on the target transcript or paired to the target sequence to promote spreading of silencing on the target transcript; and (d) transforming the artificial miRNA into a plant.

Multiple sense and/or anti-sense suppression elements for more than one GA oxidase target can be arranged serially in tandem or arranged in tandem segments or repeats, such as tandem inverted repeats, which can also be interrupted by one or more spacer sequence(s), and the sequence of each suppression element can target one or more GA oxidase gene(s). Furthermore, a sense or anti-sense sequence of the suppression element may not be perfectly matched or complementary to the targeted GA oxidase gene sequence, depending on the sequence and length of the suppression element. Even shorter RNAi suppression elements from about 19 nucleotides to about 27 nucleotides in length can have one or more mismatches or non-complementary bases, yet still be effective at suppressing the target GA oxidase gene. Accordingly, a sense or anti-sense suppression element sequence can be at least 80%, at least 85%, at least 90%, at least 95%, at least 96%, at least 97%, at least 98%, at least 99%, at least 99.5% or 100% identical to a corresponding sequence of at least a segment or portion of the targeted GA oxidase gene, or its complementary sequence, respectively.

For suppression of GA oxidase gene(s) using an inverted repeat or a transcribed dsRNA, a transcribable DNA sequence or suppression element can comprise a sense sequence that comprises a segment or portion of a targeted GA oxidase gene and an anti-sense sequence that is complementary to a segment or portion of the targeted GA oxidase gene, where the sense and anti-sense DNA sequences are arranged in tandem. The sense and/or anti-sense sequences, respectively, can each be less than 100% identical or complementary to a segment or portion of the targeted GA oxidase gene as described above. A sense and anti-sense sequences can be separated by a spacer sequence, such that the RNA molecule transcribed from the suppression element forms a stem, loop or stem-loop structure between the sense and anti-sense sequences. A suppression element can instead comprise multiple sense and anti-sense sequences that are arranged in tandem, which can also be separated by one or more spacer sequences. Suppression elements comprising multiple sense and anti-sense sequences can be arranged as a series of sense sequences followed by a series of anti-sense sequences, or as a series of tandemly arranged sense and anti-sense sequences. Alternatively, one or more sense DNA sequences can be expressed separately from the one or more anti-sense sequences (i.e., one or more sense DNA sequences can be expressed from a first transcribable DNA sequence, and one or more anti-sense DNA sequences can be expressed from a second transcribable DNA sequence, wherein the first and second transcribable DNA sequences are expressed as separate transcripts).

For suppression of GA oxidase gene(s) using a microRNA (miRNA), the transcribable DNA sequence or suppression element can comprise a DNA sequence derived from a miRNA sequence native to a virus or eukaryote, such as an animal or plant, or modified or derived from such a native miRNA sequence. Such native or native-derived miRNA sequences can form a fold back structure and serve as a scaffold for the precursor miRNA (pre-miRNA), and can correspond to the stem region of a native miRNA precursor sequence, such as from a native (or native-derived) primary-miRNA (pri-miRNA) or pre-miRNA sequence. However, in addition to these native or native-derived miRNA scaffold or preprocessed sequences, engineered or synthetic miRNAs of the present aspects further comprise a sequence corresponding to a segment or portion of the targeted GA oxidase gene(s). Thus, in addition to the pre-processed or scaffold miRNA sequences, the suppression element can further comprise a sense and/or anti-sense sequence that corresponds to a segment or portion of a targeted GA oxidase gene, and/or a sequence that is complementary thereto, although one or more sequence mismatches can be tolerated.

GA oxidase gene(s) can also be suppressed using one or more small interfering RNAs (siRNAs). The siRNA pathway involves the non-phased cleavage of a longer double-stranded RNA intermediate ("RNA duplex") into small interfering RNAs (siRNAs). The size or length of siRNAs ranges from about 19 to about 25 nucleotides or base pairs, but common classes of siRNAs include those containing 21 or 24 base pairs. Thus, a transcribable DNA sequence or suppression element can encode a RNA molecule that is at least about 19 to about 25 nucleotides (or more) in length, such as at least 19, 20, 21, 22, 23, 24, or 25 nucleotides in length. For siRNA suppression, a recombinant DNA molecule, construct or vector can be provided comprising a transcribable DNA sequence and suppression element encoding a siRNA molecule for targeted suppression of a GA oxidase gene(s). A transcribable DNA sequence and suppression element can be at least 19 nucleotides in length and have a sequence corresponding to one or more GA oxidase gene(s), and/or a sequence complementary to one or more GA oxidase gene(s).

GA oxidase gene(s) can also be suppressed using one or more trans-acting small interfering RNAs (ta-siRNAs). In the ta-siRNA pathway, miRNAs serve to guide in-phase processing of siRNA primary transcripts in a process that requires an RNA-dependent RNA polymerase for production of a double-stranded RNA precursor. ta-siRNAs are defined by lack of secondary structure, a miRNA target site that initiates production of double-stranded RNA, requirements of DCL4 and an RNA-dependent RNA polymerase (RDR6), and production of multiple perfectly phased ~21-nt small RNAs with perfectly matched duplexes with 2-nucleotide 3' overhangs (see Allen et al. (2005) Cell, 121:207-221). The size or length of ta-siRNAs ranges from about 20 to about 22 nucleotides or base pairs, but are mostly commonly 21 base pairs. A transcribable DNA sequence or suppression element of the present invention can encode a RNA molecule that is at least about 20 to about 22 nucleotides in length, such as 20, 21, or 22 nucleotides in length. For ta-siRNA suppression, a recombinant DNA molecule, construct or vector is thus provided comprising a transcribable DNA sequence or suppression element encoding a ta-siRNA molecule for targeted suppression of a GA oxidase gene(s). Such a transcribable DNA sequence and suppression element can be at least 20 nucleotides in length and have a sequence corresponding to one or more GA oxidase gene(s) and/or a sequence complementary to one or more GA oxidase gene(s). For methods of constructing suitable ta-siRNA scaffolds, see, e.g., U.S. Pat. No. 9,309,512, which is incorporated herein by reference in its entirety.

According to an aspect of the present disclosure, a seed of the modified corn plant is produced, in which the seed comprises a first expression cassette and DNA sequence encoding a non-coding RNA for suppression of one more GA20 oxidase genes and/or one or more GA3 oxidase genes, or one or more mutated or edited GA20 and/or GA3 oxidase genes, a second expression cassette and DNA sequence encoding one or more CO or COL polypeptides, and a third expression cassette and DNA sequence encoding one or more MADS-box polypeptides. In an aspect, a progeny plant grown from the seed is semi-dwarf and has one or more improved ear traits, relative to a control corn plant that does not have the suppression element, mutation or edit, the CO/COL transgene, and the MADS-box transgene. In another aspect, a commodity or commodity product is produced from the seed of the modified corn plant comprising the first transcribable DNA sequence encoding a non-coding RNA for suppression of one more GA20 oxidase genes and/or one or more GA3 oxidase genes, or one or more mutated or edited GA20 and/or GA3 oxidase genes, the second DNA sequence encoding one or more CO or COL polypeptides, and the third DNA sequence encoding one or more MADS-box polypeptides.

A transgenic plant can be produced by any suitable transformation method as provided herein to produce a transgenic $R_0$ plant, which can then be selfed or crossed to other plants to generate $R_1$ seed and subsequent progeny generations and seed through additional crosses, etc. Aspects of the present disclosure further include a plant cell, tissue, explant, plant part, etc., comprising one or more transgenic cells having a transformation event or genomic insertion of a recombinant DNA or polynucleotide sequence comprising a transcribable DNA sequence encoding a non-coding RNA molecule that targets an endogenous GA3 or GA20 oxidase gene for suppression, a transgene encoding a CO or COL polypeptide, and a transgene encoding a MADS-box polypeptide.

Transgenic plants, plant cells, seeds, and plant parts of the present disclosure can be homozygous or hemizygous for a transgenic event or insertion in at least one plant cell thereof, or a targeted genome editing event or mutation, and plants, plant cells, seeds, and plant parts of the present disclosure can contain any number of copies of such transgenic event (s), insertion(s) mutation(s), and/or edit(s). The dosage or amount of expression of a transgene or transcribable DNA sequence can be altered by its zygosity and/or number of copies, which can affect the degree or extent of phenotypic changes in the transgenic plant, etc.

Transgenic plants provided herein can include a variety of monocot cereal plants, including crop plants, such as corn, wheat, rice and sorghum. Indeed, recombinant DNA molecules or constructs of the present disclosure can be used to create beneficial traits in cereal plants such as corn without off-types using only a single copy of the transgenic event, insertion or construct.

Aspects of the present disclosure further include methods for making or producing transgenic plants, such as by transformation, crossing, etc., wherein the method comprises introducing a recombinant DNA molecule, construct or sequence into a plant cell, and then regenerating or developing the transgenic plant from the transformed or edited plant cell, which can be performed under selection pressure favoring a transgenic event. Also provided by the present specification is a method for producing a modified corn plant, the method comprising: a) introducing into a corn cell a first recombinant expression cassette comprising a coding sequence for a CO or COL polypeptide, wherein the corn cell comprises a second recombinant expression cassette comprising a transcribable DNA sequence encoding a non-coding RNA for suppression of one or more GA3 oxidase genes and/or one or more GA20 oxidase genes and a third recombinant expression cassette comprising a coding sequence for a MADS-box polypeptide; and b) regenerating or developing a modified corn plant from the corn cell, wherein the modified corn plant comprises the first, second, and third recombinant expression cassettes.

Also provided by the present specification is a method for producing a modified corn plant, the method comprising: introducing into a corn cell a first recombinant expression cassette comprising a coding sequence for a MADS-box polypeptide, wherein the corn cell comprises a second recombinant expression cassette comprising a transcribable DNA sequence encoding a non-coding RNA for suppression of one or more GA3 oxidase genes and/or one or more GA20 oxidase genes and a third recombinant expression cassette comprising a coding sequence for a CO or COL polypeptide; and b) regenerating or developing a modified corn plant from the corn cell, wherein the modified corn plant comprises the first, second, and third recombinant expression cassettes.

Also provided by the present specification is a method for producing a modified corn plant, the method comprising: a) introducing into a corn cell a first recombinant expression cassette comprising a transcribable DNA sequence encoding a non-coding RNA for suppression of one or more GA3 oxidase genes and/or one or more GA20 oxidase genes, wherein the corn cell comprises a second recombinant expression cassette comprising a coding sequence for a MADS-box polypeptide and a third recombinant expression cassette comprising a coding sequence for a CO or COL polypeptide; and b) regenerating or developing a modified corn plant from the corn cell, wherein the modified corn plant comprises the first, second, and third recombinant expression cassettes.

Also provided by the present specification is a method for producing a modified corn plant, the method comprising: a) introducing into a corn cell 1) a first recombinant expression cassette comprising a transcribable DNA sequence encoding a non-coding RNA for suppression of one or more GA3 oxidase genes and/or GA20 oxidase genes, 2) a second recombinant expression cassette comprising a coding sequence for a CO or COL polypeptide, and 3) a third recombinant expression cassette comprising a coding sequence for a MADS-box polypeptide; and b) regenerating or developing a modified corn plant from the corn cell, wherein the modified corn plant comprises the first, second, and third recombinant expression cassettes.

Further provided by the present specification is a method for producing a modified corn plant, the method comprising: a) crossing a first modified corn plant with a second modified corn plant, wherein the expression or activity of one or more endogenous GA3 oxidase genes and/or GA20 oxidase genes is reduced in the first modified corn plant relative to a wildtype control, and wherein the second modified corn plant comprises a first recombinant expression cassette comprising a coding sequence for a CO or COL polypeptide and a second recombinant expression cassette comprising a coding sequence for a MADS-box polypeptide; and b) producing a progeny corn plant comprising the first and second recombinant expression cassettes and has the reduced expression of the one or more endogenous GA3 oxidase genes and/or GA20 oxidase genes.

Further provided by the present specification is a method for producing a modified corn plant, the method comprising: a) crossing a first modified corn plant with a second modified corn plant, wherein the first modified corn plant comprises a first recombinant expression cassette comprising a coding sequence for a CO or COL polypeptide, and wherein the second modified corn plant has its expression or activity of one or more endogenous GA3 oxidase genes and/or GA20 oxidase genes reduced relative to a wildtype control, and wherein the second modified corn plant comprises a second recombinant expression cassette comprising a coding sequence for a MADS-box polypeptide; and b) producing a progeny corn plant comprising the first and second recombinant expression cassettes and has the reduced expression of the one or more endogenous GA3 oxidase genes and/or GA20 oxidase genes.

Further provided by the present specification is a method for producing a modified corn plant, the method comprising: a) crossing a first modified corn plant with a second modified corn plant, wherein the first modified corn plant comprises a first recombinant expression cassette comprising a coding sequence for a MADS-box polypeptide, and wherein the second modified corn plant has its expression or activity of one or more endogenous GA3 oxidase genes and/or GA20 oxidase genes reduced relative to a wildtype control, and wherein the second modified corn plant comprises a second recombinant expression cassette comprising a coding sequence for a CO or COL polypeptide; and b) producing a progeny corn plant comprising the first and second recombinant expression cassettes and has the reduced expression of the one or more endogenous GA3 oxidase genes and/or GA20 oxidase genes.

Further provided by the present specification is a method for producing a modified corn plant, the method comprising: a) performing one or more crossings using one or more modified corn plants, wherein the one or more modified corn plants are selected from the group consisting of 1) a modified corn plant that has its expression or activity of one or more endogenous GA3 oxidase genes and/or GA20 oxidase genes reduced relative to a wildtype control, 2) a modified corn plant comprising a recombinant expression cassette comprising a coding sequence for a CO or COL polypeptide, 3) a modified corn plant comprising a recombinant expression cassette comprising a coding sequence for a MADS-box polypeptide, 4) a modified corn plant that has its expression or activity of one or more endogenous GA3 oxidase genes and/or GA20 oxidase genes reduced relative to a wildtype control and comprises a recombinant expression cassette comprising a coding sequence for a CO or COL polypeptide, 5) a modified corn plant that has its expression or activity of one or more endogenous GA3 oxidase genes and/or GA20 oxidase genes reduced relative to a wildtype control and comprises a recombinant expression cassette comprising a coding sequence for a MADS-box polypeptide, and 6) a modified corn plant comprises a first recombinant expression cassette comprising a coding sequence for a CO or COL polypeptide and a second recombinant expression cassette comprising a coding sequence for a MADS-box polypeptide, and b) producing a progeny corn plant comprising the first and second recombinant expression cassettes and has the reduced expression of the one or more endogenous GA3 oxidase genes and/or GA20 oxidase genes.

Further provided by the present specification is a method for producing a modified corn plant, the method comprising: a) introducing into a corn cell a first recombinant expression cassette comprising a coding sequence for a CO or COL polypeptide operably linked to a first plant-expressible promoter, and wherein the corn cell comprises (1) one or more mutations and/or edits in one or more endogenous GA3 oxidase and/or GA20 oxidase genes and (2) a second recombinant expression cassette comprising a coding sequence for a MADS-box polypeptide operably linked to a second plant-expressible promoter; and b) regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

Further provided by the present specification is a method for producing a modified corn plant, the method comprising: a) introducing into a corn cell a first recombinant expression cassette comprising a coding sequence for a MADS-box polypeptide operably linked to a first plant-expressible promoter, and wherein the corn cell comprises (1) one or more mutations and/or edits in one or more endogenous GA3 oxidase and/or GA20 oxidase genes and (2) a second recombinant expression cassette comprising a coding sequence for a CO or COL polypeptide operably linked to a second plant-expressible promoter; and b) regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

According to another aspect of the present disclosure, recombinant DNA constructs, methods and modified plants, plant parts and plant cells are provided comprising a first recombinant expression cassette comprising a coding sequence for a MADS-box polypeptide operably linked to a first plant-expressible promoter, and a second recombinant expression cassette comprising a coding sequence for a CO or COL polypeptide operably linked to a second plant-expressible promoter, but with or without any mutation, editing and/or suppression of an endogenous GA3 oxidase and/or GA20 oxidase gene(s). Modified plants comprising these recombinant expression cassettes and/or produced by these methods may have one or more beneficial or improved ear and/or yield traits as provided herein relative to (i) plants containing a recombinant expression cassette encoding only one of (x) a MADS-box polypeptide and (y) a CO or COL polypeptide, and/or (ii) control plants.

In an aspect, the present specification provides a modified corn plant or a plant part thereof comprising 1) a first recombinant expression cassette comprising a first DNA sequence encoding a CONSTANS (CO) or CONSTANS-like (COL) polypeptide, and 2) a second recombinant expression cassette comprising a second DNA sequence encoding a MADS-box polypeptide. In an aspect, a CO or COL polypeptide comprises a *Physcomitrella patens* CONSTANS-like 1 (PpCOL1) polypeptide. In another aspect, a MADS-box polypeptide comprises a maize ZMM19 polypeptide. Also provided are a plurality of the foregoing modified corn plants in a field. In another aspect, further provided is a seed of any of the foregoing modified corn plants, wherein the seed comprises the first and second recombinant expression cassettes. In a further aspect, also provided is a commodity or commodity product produced from the foregoing seed, wherein the commodity or commodity product comprises the first and second recombinant expression cassettes.

In another aspect, the present specification provides a method for producing a modified corn plant, the method comprising: (a) introducing into a corn cell a first recombinant expression cassette comprising a coding sequence for a CO or COL polypeptide, wherein the corn cell comprises a second recombinant expression cassette comprising a coding sequence for a MADS-box polypeptide; and (b) regenerating or developing a modified corn plant from the corn cell, wherein the modified corn plant comprises the first and second recombinant expression cassettes.

In another aspect, the present specification also provides a method for producing a modified corn plant, the method comprising: (a) introducing into a corn cell a first recombinant expression cassette comprising a coding sequence for a MADS-box polypeptide, wherein the corn cell comprises a second recombinant expression cassette comprising a coding sequence for a CO or COL polypeptide; and (b) regenerating or developing a modified corn plant from the corn cell, wherein the modified corn plant comprises the first and second recombinant expression cassettes.

In another aspect, the present specification further provides a method for producing a modified corn plant, the method comprising: (a) introducing into a corn cell 1) a first recombinant expression cassette comprising a coding sequence for a CO or COL polypeptide, and 2) a second recombinant expression cassette comprising a coding sequence for a MADS-box polypeptide; and (b) regenerating or developing a modified corn plant from the corn cell, wherein the modified corn plant comprises the first and second recombinant expression cassettes.

In an aspect, the present specification provides a method for producing a modified corn plant, the method comprising: (a) crossing a first modified corn plant with a second modified corn plant, wherein the first modified corn plant comprises a first recombinant expression cassette comprising a coding sequence for a CO or COL polypeptide, and wherein the second modified corn plant comprises a second recombinant expression cassette comprising a coding sequence for a MADS-box polypeptide; and (b) producing a progeny corn plant comprising the first and second recombinant expression cassettes. Also provided is a method further comprising selecting a progeny corn plant having a desired trait.

In an aspect, the present specification provides a method for producing a modified corn plant, the method comprising: (a) introducing into a corn cell a first recombinant expression cassette comprising a coding sequence for a CO or COL polypeptide operably linked to a first plant-expressible promoter, and wherein the corn cell comprises a second recombinant expression cassette comprising a coding sequence for a MADS-box polypeptide operably linked to a second plant-expressible promoter; and (b) regenerating or developing a modified corn plant from the corn cell, wherein the modified corn plant comprises the first and second recombinant expression cassettes.

In another aspect, the present specification provides a method for producing a modified corn plant, the method comprising: (a) introducing into a corn cell a first recombinant expression cassette comprising a coding sequence for a MADS-box polypeptide operably linked to a first plant-expressible promoter, and wherein the corn cell comprises a second recombinant expression cassette comprising a coding sequence for a CO or COL polypeptide operably linked to a second plant-expressible promoter; and (b) regenerating or developing a modified corn plant from the corn cell, wherein the modified corn plant comprises the first and second recombinant expression cassettes.

In another aspect, the present specification provides a modified corn plant comprising a first recombinant expression cassette comprising a coding sequence for a CO or COL polypeptide operably linked to a first plant-expressible promoter, and a second recombinant expression cassette comprising a coding sequence for a MADS-box polypeptide operably linked to a second plant-expressible promoter.

In a further aspect, the present specification provides a plurality of modified corn plants in a field, each modified corn plant comprising (a) a first recombinant expression cassette comprising a coding sequence for a CO or COL polypeptide operably linked to a first plant-expressible promoter, and (b) a second recombinant expression cassette comprising a coding sequence for a MADS-box polypeptide operably linked to a second plant-expressible promoter.

In another aspect, the present specification provides a recombinant DNA construct comprising a first expression cassette comprising a coding sequence for a CO or COL polypeptide operably linked to a first plant-expressible promoter, and a second recombinant expression cassette comprising a coding sequence for a MADS-box polypeptide operably linked to a second plant-expressible promoter. Also provided is a transformation vector comprising such recombinant DNA construct, or a modified corn plant or a plant part thereof comprising such recombinant DNA construct.

According to an aspect of the present disclosure, methods are provided for transforming a cell, tissue or explant with a recombinant DNA molecule or construct comprising DNA sequences or transgenes operably linked to one or more promoters to produce a transgenic or genome edited cell. According to other aspects of the present disclosure, methods are provided for transforming a plant cell, tissue or explant with a recombinant DNA molecule or construct comprising transcribable DNA sequences or transgenes operably linked to one or more plant-expressible promoters to produce a transgenic or genome edited plant or plant cell.

Numerous methods for transforming chromosomes or plastids in a plant cell with a recombinant DNA molecule or construct are known in the art, which can be used according to methods of the present disclosure to produce a transgenic plant cell and plant. Any suitable method or technique for transformation of a plant cell known in the art can be used according to present methods.

Effective methods for transformation of plants include bacterially mediated transformation, such as *Agrobacterium*-mediated or *Rhizobium*-mediated transformation and microprojectile particle bombardment-mediated transformation. A variety of methods are known in the art for transforming explants with a transformation vector via bacterially mediated transformation or microprojectile particle bombardment and then subsequently culturing, etc., those explants to regenerate or develop transgenic plants.

In an aspect, the methods for producing a transgenic or modified corn plant disclosed in the present disclosure comprise obtaining the first corn cell and the transgenic corn cell via *Agrobacterium*-mediated transformation.

In another aspect, the methods for producing a transgenic or modified corn plant disclosed in the present disclosure comprise obtaining the first corn cell and the transgenic corn cell via microprojectile particle bombardment-mediated transformation.

Other methods for plant transformation, such as microinjection, electroporation, vacuum infiltration, pressure, sonication, silicon carbide fiber agitation, PEG-mediated transformation, etc., are also known in the art. Transgenic plants produced by these transformation methods can be chimeric or non-chimeric for the transformation event depending on the methods and explants used.

Methods of transforming plant cells are well known by persons of ordinary skill in the art. For instance, specific instructions for transforming plant cells by microprojectile particle bombardment with particles coated with recombinant DNA are found in U.S. Pat. Nos. 5,550,318; 5,538,880 6,160,208; 6,399,861; and 6,153,812 and *Agrobacterium*-mediated transformation is described in U.S. Pat. Nos. 5,159,135; 5,824,877; 5,591,616; 6,384,301; 5,750,871; 5,463,174; and 5,188,958, all of which are incorporated herein by reference. Additional methods for transforming plants can be found in, for example, Compendium of Transgenic Crop Plants (2009) Blackwell Publishing. Any appropriate method known to those skilled in the art can be used to transform a plant cell with any of the nucleic acid molecules provided herein.

Further provided by the present specification is a method for producing a modified corn plant, the method comprising: a) mutating or editing one or more endogenous GA3 oxidase genes and/or one or more GA20 oxidase genes in a corn cell, wherein the corn cell comprises (1) a first recombinant expression cassette comprising a encoding sequence for a CO or COL polypeptide operably linked to a first plant-expressible promoter and (2) a second recombinant expression cassette comprising a encoding sequence for a MADS-box polypeptide linked to a second plant-expressible promoter; and b) regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

In an aspect, the present specification provides a modified corn plant comprising 1) one or more mutations or edits at or near one or more endogenous GA20 oxidase and/or GA3 oxidase genes, wherein the expression or activity of the one or more endogenous GA20 oxidase and/or GA3 oxidase genes is reduced relative to a wildtype control plant, 2) a first recombinant expression cassette comprising a coding sequence for a CO or COL polypeptide operably linked to a first plant-expressible promoter, and 3) a second recombinant expression cassette comprising a coding sequence for a MADS-box polypeptide operably linked to a second plant-expressible promoter.

In another aspect, present specification provides a plurality of modified corn plants in a field, each modified corn plant comprising 1) one or more mutations or edits at or near one or more endogenous GA20 oxidase and/or GA3 oxidase genes, wherein the expression of the one or more endogenous GA20 oxidase and/or GA3 oxidase genes are reduced relative to a wildtype control plant, 2) a first recombinant expression cassette comprising a coding sequence for a CO or COL polypeptide operably linked to a first plant-expressible promoter, and 3) a second recombinant expression cassette comprising a coding sequence for a MADS-box polypeptide operably linked to a second plant-expressible promoter.

In an aspect, described herein are methods of integrating an insertion sequence encoding one or more CO or COL polypeptides into the genome of a plant cell via site-directed integration. Such methods comprise creating a double-stranded break (DSB) in the genome of the plant cell such that the insertion sequence is integrated at the site of the DSB. In an aspect, the insertion/donor sequence encoding one or more CO or COL polypeptides can be integrated in a targeted manner into the genome of a cell at the location of a DSB. DSBs can be created by any mechanism, including but are not limited to, zinc finger nucleases (ZFN), transcription activator-like effector nuclease (TALEN), meganucleases, recombinases, transposases, and RNA-guided nucleases (e.g., Cas9 and Cpf1) in a CRISPR based genome editing system.

When Cas9 cleaves targeted DNA, endogenous double stranded break (DSB) repair mechanisms are activated. DSBs can be repaired via non-homologous end joining (NHEJ), which can incorporate insertions or deletions (indels) into the targeted locus. If two DSBs flanking one target region are created, the breaks can be repaired by reversing the orientation of the targeted DNA. Alternatively, if an insertion sequence of a donor template with homology to the target DNA sequence is provided, the DSB can be repaired via homology-directed repair or homologous recombination (HR). This repair mechanism allows for the precise integration of an insertion sequence into the targeted DNA sequence.

As used herein, an "insertion sequence" of a donor template is a sequence designed for targeted insertion into the genome of a plant cell, which can be of any suitable length. For example, an insertion sequence can be between 2 and 50,000, between 2 and 10,000, between 2 and 5000, between 2 and 1000, between 2 and 500, between 2 and 250, between 2 and 100, between 2 and 50, between 2 and 30, between 15 and 50, between 15 and 100, between 15 and 500, between 15 and 1000, between 15 and 5000, between 18 and 30, between 18 and 26, between 20 and 26, between 20 and 50, between 20 and 100, between 20 and 250, between 20 and 500, between 20 and 1000, between 20 and 5000, between 20 and 10,000, between 50 and 250, between 50 and 500, between 50 and 1000, between 50 and 5000, between 50 and 10,000, between 100 and 250, between 100 and 500, between 100 and 1000, between 100 and 5000, between 100 and 10,000, between 250 and 500, between 250 and 1000, between 250 and 5000, or between 250 and 10,000 nucleotides or base pairs in length.

According to some aspects, a donor template may not comprise a sequence for insertion into a genome, and instead comprise one or more homology sequences that include(s) one or more mutations, such as an insertion, deletion, substitution, etc., relative to the genomic sequence at a target site within the genome of a plant. Alternatively, a donor template can comprise a sequence that does not comprise a coding or transcribable DNA sequence, wherein the insertion sequence is used to introduce one or more mutations into a target site within the genome of a plant.

A donor template provided herein can comprise at least one, at least two, at least three, at least four, at least five, at least six, at least seven, at least eight, at least nine, or at least ten genes or transcribable DNA sequences. Alternatively, a donor template can comprise no genes. Without being limiting, a gene or transcribable DNA sequence of a donor template can include, for example, an insecticidal resistance gene, an herbicide tolerance gene, a nitrogen use efficiency gene, a water use efficiency gene, a nutritional quality gene, a DNA binding gene, a selectable marker gene, an RNAi or suppression construct, a site-specific genome modification enzyme gene, a single guide RNA of a CRISPR/Cas9 system, a geminivirus-based expression cassette, or a plant viral expression vector system. A donor template can comprise a promoter, such as a tissue-specific or tissue-preferred promoter, a constitutive promoter, or an inducible promoter. A donor template can comprise a leader, enhancer, promoter, transcriptional start site, 5'-UTR, one or more exon(s), one or more intron(s), transcriptional termination site, region or sequence, 3'-UTR, and/or polyadenylation signal. The leader, enhancer, and/or promoter can be operably linked to a gene or transcribable DNA sequence encoding a non-coding RNA, a guide RNA, an mRNA and/or protein.

In an aspect, an insertion sequence of a donor template of the present disclosure comprises a DNA sequence encoding a CO or COL polypeptide, wherein the CO or COL polypeptide is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 182-458 and a functional fragment thereof.

In an aspect, an insertion sequence of a donor template of the present disclosure comprises a DNA sequence encoding a PpCOL polypeptide, wherein the DNA sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

In an aspect, an insertion sequence of a donor template of the present disclosure comprises a DNA sequence encoding a MADS-box polypeptide, wherein the MADS-box polypeptide is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 459-483 and a functional fragment thereof.

In an aspect, an insertion sequence of a donor template of the present disclosure comprises a DNA sequence encoding a MADS-box polypeptide, wherein the DNA sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

In an aspect, a "modified plant(s)," "modified corn plant(s)," "transgenic plant(s)," or "transgenic corn plant(s)" produced according to a method disclosed in the present disclosure comprises (1) a first transcribable DNA sequence encoding a non-coding RNA for suppression of one or more GA20 oxidase genes and/or one or more GA3 oxidase genes, and (2) a second DNA sequence encoding one or more CO or COL polypeptides.

In another aspect, a "modified plant(s)," "modified corn plant(s)," "transgenic plant(s)," or "transgenic corn plant(s)" produced according to a method disclosed in the present disclosure comprises (1) a DNA sequence encoding one or more CO or COL polypeptides, and (2) a reduced expression of one or more endogenous GA3 oxidase genes or GA20 oxidase genes relative to a wildtype control. In an aspect, the reduced expression of the one or more endogenous GA20 oxidase genes or GA3 oxidase genes is caused by a mutation or edit at or near the one or more endogenous GA20 oxidase genes or GA3 oxidase genes.

Transgenic or modified plants produced by transformation methods can be chimeric or non-chimeric for the transformation event depending on the methods and explants used. Methods are further provided for expressing a non-coding RNA molecule that targets an endogenous GA oxidase gene for suppression in one or more plant cells or tissues under the control of a plant-expressible promoter, such as a constitutive, tissue-specific, tissue-preferred, vascular and/or leaf promoter as provided herein. Such methods can be used to create transgenic cereal or corn plants having a shorter, semi-dwarf stature, reduced internode length, increased stalk/stem diameter, and/or improved lodging resistance. Such transgenic cereal or corn plants can further have other traits that can be beneficial for yield, such as reduced green snap, deeper roots, increased leaf area, earlier canopy closure, improved drought tolerance, increased nitrogen use efficiency, increased water use efficiency, higher stomatal conductance, lower ear height, increased foliar water content, reduced anthocyanin content and/or area in leaves under normal or nitrogen or water limiting stress conditions, increased ear weight, increased seed or kernel number, increased seed or kernel weight, increased yield, and/or increased harvest index, relative to a wild type or control plant. As used herein, "harvest index" refers to the mass of the harvested grain divided by the total mass of the above-ground biomass of the plant over a harvested area.

Alternatively, nucleotide sequences of the disclosure can be introduced into an organism and allowed to undergo recombination with homologous regions of the organism's genome. Such homologous recombination approaches are well known to those of ordinary skill in the art and can be used to stably incorporate sequences of the disclosure into an organism. In an aspect, nucleotide sequences of the disclosure can be used to introduce "knockout mutations" into a specific gene of an organism that shares substantial homology to the sequences of the disclosure. A knockout mutation is any mutation in the sequence of a gene that eliminates or substantially reduces the function or the level of the product encoded by the gene. Methods involving transformation of an organism followed by homologous recombination to stably integrate the sequences of the disclosure into the genome organism are encompassed by the disclosure. The disclosure is particularly directed to methods where sequences of the disclosure are utilized to alter the growth of an organism. Such methods encompass use of the sequences of the disclosure to interfere with the function of one or more GA20 oxidase genes or GA3 oxidase genes. In an aspect, a knockout mutation of one or more GA20 oxidase or GA3 oxidase genes can be introduced into a corn cell via recombination to reduce the expression of the one or more of GA20 oxidase or GA3 oxidase genes in the corn cell.

Cells that have been transformed can be grown into plants in accordance with conventional ways. See, for example, McCormick et al. (1986) *Plant Cell Reports* 5:81-84. These plants can then be grown, and either pollinated with the same transformed strain or different strains, and the resulting hybrid having constitutive expression of the desired phenotypic characteristic identified. Two or more generations can be grown to ensure that constitutive expression of the desired phenotypic characteristic is stably maintained and inherited and then seeds harvested to ensure constitutive expression of the desired phenotypic characteristic has been achieved.

In an aspect, the methods for producing a transgenic or modified corn plant further comprises culturing the transgenic corn plant of step (b) or a plant part thereof in the presence of a selection agent. In another aspect, the selection agent is kanamycin.

Recipient cell or explant targets for transformation include, but are not limited to, a seed cell, a fruit cell, a leaf cell, a cotyledon cell, a hypocotyl cell, a meristem cell, an embryo cell, an endosperm cell, a root cell, a shoot cell, a stem cell, a pod cell, a flower cell, an inflorescence cell, a stalk cell, a pedicel cell, a style cell, a stigma cell, a receptacle cell, a petal cell, a sepal cell, a pollen cell, an anther cell, a filament cell, an ovary cell, an ovule cell, a pericarp cell, a phloem cell, a bud cell, or a vascular tissue cell. In another aspect, this disclosure provides a plant chloroplast. In a further aspect, this disclosure provides an epidermal cell, a stomata cell, a trichome cell, a root hair cell, a storage root cell, or a tuber cell. In another aspect, this disclosure provides a protoplast. In another aspect, this disclosure provides a plant callus cell.

Transformation of a target plant material or explant can be practiced in tissue culture on nutrient media, for example a mixture of nutrients that allow cells to grow in vitro or cell culture. Transformed explants, cells or tissues can be subjected to additional culturing steps, such as callus induction, selection, regeneration, etc., as known in the art. Transformation can also be carried out without creation or use of a callus tissue. Transformed cells, tissues or explants containing a recombinant DNA sequence insertion or event can be grown, developed or regenerated into transgenic plants in culture, plugs, or soil according to methods known in the art. Transgenic plants can be further crossed to themselves or other plants to produce transgenic seeds and progeny. A transgenic plant can also be prepared by crossing a first plant comprising the recombinant DNA sequence or transformation event with a second plant lacking the insertion. For example, a recombinant DNA construct or sequence can be introduced into a first plant line that is amenable to transformation, which can then be crossed with a second plant line to introgress the recombinant DNA construct or sequence into the second plant line. Progeny of these crosses can be further back crossed into the more desirable line multiple times, such as through 6 to 8 generations or back crosses, to produce a progeny plant with substantially the same genotype as the original parental line, but for the introduction of the recombinant DNA construct or sequence.

Any cell from which a fertile plant can be regenerated is contemplated as a useful recipient cell for practice of this disclosure. Callus can be initiated from various tissue sources, including, but not limited to, immature embryos or parts of embryos, seedling apical meristems, microspores, and the like. Those cells which are capable of proliferating as callus can serve as recipient cells for transformation. Practical transformation methods and materials for making transgenic plants of this disclosure (e.g., various media and recipient target cells, transformation of immature embryos, and subsequent regeneration of fertile transgenic plants) are disclosed, for example, in U.S. Pat. Nos. 6,194,636 and 6,232,526 and U. S. Patent Application Publication 2004/0216189, all of which are incorporated herein by reference.

Transformed explants, cells or tissues can be subjected to additional culturing steps, such as callus induction, selection, regeneration, etc., as known in the art. Transformed cells, tissues or explants containing a recombinant DNA insertion can be grown, developed or regenerated into transgenic plants in culture, plugs or soil according to methods known in the art. In an aspect, this disclosure provides plant cells that are not reproductive material and do not mediate the natural reproduction of the plant. In another aspect, this disclosure also provides plant cells that are reproductive material and mediate the natural reproduction of the plant. In another aspect, this disclosure provides plant cells that cannot maintain themselves via photosynthesis. In another aspect, this disclosure provides somatic plant cells. Somatic cells, contrary to germline cells, do not mediate plant reproduction.

Transgenic plants can be further crossed to themselves or other plants to produce transgenic seeds and progeny. A transgenic plant can also be prepared by crossing a first plant comprising the recombinant DNA sequence or transformation event with a second plant lacking the insertion. For example, a recombinant DNA construct or sequence can be introduced into a first plant line that is amenable to transformation, which can then be crossed with a second plant line to introgress the recombinant DNA construct or sequence into the second plant line. Progeny of these crosses can be further back crossed into the more desirable line multiple times, such as through 6 to 8 generations or back crosses, to produce a progeny plant with substantially the same genotype as the original parental line but for the introduction of the recombinant DNA construct or sequence.

A plant, cell, or explant provided herein can be of an elite variety or an elite line. An elite variety or an elite line refers to any variety that has resulted from breeding and selection for superior agronomic performance. A plant, cell, or explant provided herein can be a hybrid plant, cell, or explant. As used herein, a "hybrid" is created by crossing two plants from different varieties, lines, or species, such that the progeny comprises genetic material from each parent. Skilled artisans recognize that higher order hybrids can be generated as well. For example, a first hybrid can be made by crossing Variety C with Variety D to create a C×D hybrid, and a second hybrid can be made by crossing Variety E with Variety F to create an E×F hybrid. The first and second hybrids can be further crossed to create the higher order hybrid (C×D)×(E×F) comprising genetic information from all four parent varieties.

For *Agrobacterium*-mediated transformation, the transformation vector can comprise an engineered transfer DNA (or T-DNA) segment or region having two border sequences, a left border (LB) and a right border (RB), flanking at least a transcribable DNA sequence or transgene, such that insertion of the T-DNA into the plant genome will create a transformation event for the transcribable DNA sequence, transgene or expression cassette. In other words, the transgene, a transcribable DNA sequence, transgene or expression cassette encoding the site-specific nuclease(s), and/or sgRNA(s) or crRNA(s) would be located between the left and right borders of the T-DNA, perhaps along with an additional transgene(s) or expression cassette(s), such as a plant selectable marker transgene and/or other gene(s) of agronomic interest that can confer a trait or phenotype of agronomic interest to a plant.

A plant selectable marker transgene in a transformation vector or construct of the present disclosure can be used to assist in the selection of transformed cells or tissue due to the presence of a selection agent, such as an antibiotic or herbicide, wherein the plant selectable marker transgene provides tolerance or resistance to the selection agent. Thus, the selection agent can bias or favor the survival, development, growth, proliferation, etc., of transformed cells expressing the plant selectable marker gene, such as to increase the proportion of transformed cells or tissues in the $R_0$ plant.

A plant selectable marker transgene in a transformation vector or construct of the present disclosure can be used to assist in the selection of transformed cells or tissue due to the presence of a selection agent, such as an antibiotic or herbicide, wherein the plant selectable marker transgene provides tolerance or resistance to the selection agent. Thus, the selection agent can bias or favor the survival, development, growth, proliferation, etc., of transformed cells expressing the plant selectable marker gene, such as to increase the proportion of transformed cells or tissues in the $R_0$ plant. Commonly used plant selectable marker genes include, for example, those conferring tolerance or resistance to antibiotics, such as kanamycin and paromomycin (nptII), hygromycin B (aph IV), streptomycin or spectinomycin (aadA) and gentamycin (aac3 and aacC4), or those conferring tolerance or resistance to herbicides such as glufosinate (bar or pat), dicamba (DMO) and glyphosate (aroA or EPSPS). Plant screenable marker genes can also be used, which provide an ability to visually screen for transformants, such as luciferase or green fluorescent protein (GFP), or a gene expressing a beta glucuronidase or uidA gene (GUS) for which various chromogenic substrates are known. In some aspects, a vector or polynucleotide provided herein comprises at least one selectable marker gene selected from the group consisting of nptII, aph IV, aadA, aac3, aacC4, bar, pat, DMO, EPSPS, aroA, GFP, and GUS. Plant transformation can also be carried out in the absence of selection during one or more steps or stages of culturing, developing or regenerating transformed explants, tissues, plants and/or plant parts.

An aspect of the present disclosure relate to screening cells, tissues or plants for mutations, targeted edits or transgenes and selecting cells or plants comprising targeted edits or transgenes. Nucleic acids can be isolated using techniques routine in the art. For example, nucleic acids can be isolated using any method including, without limitation, recombinant nucleic acid technology, and/or the polymerase chain reaction (PCR). General PCR techniques are described, for example in PCR Primer: A Laboratory Manual, Dieffenbach & Dveksler, Eds., Cold Spring Harbor Laboratory Press, 1995. Recombinant nucleic acid techniques include, for example, restriction enzyme digestion and ligation, which can be used to isolate a nucleic acid. Isolated nucleic acids also can be chemically synthesized, either as a single nucleic acid molecule or as a series of oligonucleotides. Polypeptides can be purified from natural sources (e.g., a biological sample) by known methods such as DEAE ion exchange, gel filtration, and hydroxyapatite chromatography. A polypeptide also can be purified, for example, by expressing a nucleic acid in an expression vector. In addition, a purified polypeptide can be obtained by chemical synthesis. The extent of purity of a polypeptide can be measured using any appropriate method, e.g., column chromatography, polyacrylamide gel electrophoresis, or HPLC analysis.

In an aspect, this disclosure provides methods of detecting recombinant nucleic acids and polypeptides in plant cells. Without being limiting, nucleic acids also can be detected using hybridization. Hybridization between nucleic acids is discussed in detail in Sambrook et al. (1989, Molecular Cloning: A Laboratory Manual, 2nd Ed., Cold Spring Harbor Laboratory Press, Cold Spring Harbor, NY).

Polypeptides can be detected using antibodies. Techniques for detecting polypeptides using antibodies include enzyme linked immunosorbent assays (ELISAs), Western blots, immunoprecipitations and immunofluorescence. An antibody provided herein can be a polyclonal antibody or a monoclonal antibody. An antibody having specific binding affinity for a polypeptide provided herein can be generated using methods well known in the art. An antibody provided herein can be attached to a solid support such as a microtiter plate using methods known in the art.

Detection (e.g., of an amplification product, of a hybridization complex, of a polypeptide) can be accomplished using detectable labels. The term "label" is intended to encompass the use of direct labels as well as indirect labels. Detectable labels include enzymes, prosthetic groups, fluorescent materials, luminescent materials, bioluminescent materials, and radioactive materials.

The screening and selection of modified or transgenic plants or plant cells can be through any methodologies known to those having ordinary skill in the art. Examples of screening and selection methodologies include, but are not limited to, Southern analysis, PCR amplification for detection of a polynucleotide, Northern blots, RNase protection, primer-extension, RT-PCR amplification for detecting RNA transcripts, Sanger sequencing, Next Generation sequencing technologies (e.g., Illumina, PacBio, Ion Torrent, 454) enzymatic assays for detecting enzyme or ribozyme activity of polypeptides and polynucleotides, marker genotyping, and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

Modified corn plants of the present disclosure having a reduced plant height and improved ear traits relative to a wild-type or control plant can comprise a mutation (e.g., an insertion, deletion, substitution, etc.) introduced through other plant mutagenesis technique or genome editing, wherein expression of one or more GA20 or GA3 oxidase gene is reduced or eliminated in one or more tissues of the modified plant. Modified corn plants of the present disclosure having a reduced plant height and improved ear traits relative to a wild-type or control plant can comprise a transgene encoding one or more CO or COL polypeptides and one or more MADS-box polypeptides. The transgene can be introduced through other plant mutagenesis technique or genome editing.

Plant mutagenesis techniques (excluding genome editing) can include chemical mutagenesis (i.e., treatment with a chemical mutagen, such as an azide, hydroxylamine, nitrous acid, acridine, nucleotide base analog, or alkylating agent—e.g., EMS (ethylmethane sulfonate), MNU (N-methyl-N-nitrosourea), etc.), physical mutagenesis (e.g., gamma rays, X-rays, UV, ion beam, other forms of radiation, etc.), and insertional mutagenesis (e.g., transposon or T-DNA insertion). Plants or various plant parts, plant tissues or plant cells can be subjected to mutagenesis. Treated plants can be reproduced to collect seeds or produce a progeny plant, and treated plant parts, plant tissues or plant cells can be developed or regenerated into plants or other plant tissues. Mutations generated with chemical or physical mutagenesis techniques can include a frameshift, missense or nonsense mutation leading to loss of function or expression of a targeted gene, such as a GA3 or GA20 oxidase gene.

One method for mutagenesis of a gene is called "TILLING" (for targeting induced local lesions in genomes), in which mutations are created in a plant cell or tissue, preferably in the seed, reproductive tissue or germline of a plant, for example, using a mutagen, such as an EMS treatment. The resulting plants are grown and self-fertilized, and the progeny are used to prepare DNA samples. PCR amplification and sequencing of a nucleic acid sequence of a GA20 or GA3 oxidase gene can be used to identify whether a mutated plant has a mutation in the GA oxidase gene. Plants having mutations in the GA20 or GA3 oxidase gene can then be tested for an altered trait, such as reduced plant height. Alternatively, mutagenized plants can be tested for an altered trait, such as reduced plant height, and then PCR amplification and sequencing of a nucleic acid sequence of a GA20 or GA3 oxidase gene can be used to determine whether a plant having the altered trait also has a mutation in the GA oxidase gene. See, e.g., Colbert et al., 2001, *Plant*

*Physiol* 126:480-484; and McCallum et al., 2000, *Nat. Biotechnol.*, 18:455-457. TILLING can be used to identify mutations that alter the expression a gene or the activity of proteins encoded by a gene, which can be used to introduce and select for a targeted mutation in a GA20 or GA3 oxidase gene of a corn or cereal plant.

Provided in the present disclosure is a recombinant DNA construct comprising 1) a first expression cassette comprising a transcribable DNA sequence encoding a non-coding RNA for suppression of one or more GA20 oxidase or one or more GA3 oxidase genes, 2) a second expression cassette comprising a coding sequence for a CO or COL polypeptide operably linked to a first plant-expressible promoter, and 3) a third recombinant expression cassette comprising a coding sequence for a MADS-box polypeptide operably linked to a second plant-expressible promoter. In an aspect, the first, second, and third recombinant expression cassettes are in a single T-DNA segment of a transformation vector. In another aspect, the first, second, and third expression cassettes are in two different T-DNA segments of a transformation vector.

In an aspect, the transcribable DNA sequence encodes a non-coding RNA for suppression of a GA3 oxidase_1 gene, a GA3 oxidase_2 gene, or both. In another aspect, the transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37. In another aspect, the transcribable DNA sequence encodes a non-coding RNA comprising a sequence that is 80% complementary to at least 15 consecutive nucleotides of one or more of SEQ ID NOs: 28, 29, 31, 32, 36, and 37.

In another aspect, the transcribable DNA sequence encodes a non-coding RNA for suppression of a GA20 oxidase_3 gene, a GA20 oxidase_4 gene, a GA20 oxidase_5 gene, or a combination thereof. In another aspect, the transcribable DNA sequence comprises a sequence that is at least 80% complementary to at least 15 consecutive nucleotides of SEQ ID NO: 39, 53, or 55. In another aspect, the transcribable DNA sequence encodes a sequence that is at least 80% complementary to at least 15 consecutive nucleotides of SEQ ID NO: 40, 54, or 56.

In an aspect, anon-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 9, 12, 15, 30, and/or 33.

In another aspect, a non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, 14, 28, 29, 31, and/or 32.

In an aspect, anon-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or both of SEQ ID NO: 9 and/or 15.

In another aspect, a non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NO: 7, 8, 13, and/or 14.

In an aspect, a non-coding RNA sequence comprises a sequence that is (i) at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a first mRNA molecule encoding a first endogenous GA oxidase protein in a corn plant or plant cell, the first endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or similar to SEQ ID NO: 9; and (ii) at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a second mRNA molecule encoding a second endogenous GA oxidase protein in a corn plant or plant cell, the second endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or similar to SEQ ID NO: 15.

In an aspect, the coding sequence for a CO or COL polypeptide comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403. In another aspect, the coding sequence for a CO or COL polypeptide comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

In an aspect, the coding sequence for a CO or COL polypeptide encodes a Physcomitrella patens CONSTANS-like 1 (PpCOL1) polypeptide. In another aspect, the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168, or a functional fragment thereof. In another aspect, coding sequence for a CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

In an aspect, the coding sequence for a MADS-box polypeptide comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

In an aspect, the coding sequence for a MADS-box polypeptide encodes a maize ZMM19 polypeptide. In another aspect, the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176, or a functional fragment thereof. In another aspect, coding sequence for a MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Also provided herein is a recombinant DNA construct comprising 1) a first transcribable DNA sequence encoding a non-coding RNA for suppression of one or more GA20 oxidase or one or more GA3 oxidase genes, 2) a second DNA sequence encoding one or more CO or COL polypeptides, and 3) a third DNA sequence encoding one or more MADS-box polypeptides.

In an aspect, a recombinant DNA construct of the present disclosure comprises a transcribable DNA sequence encoding a non-coding RNA for suppression of one or more GA20 oxidase or one or more GA3 oxidase genes, wherein the DNA sequence is operably linked to a plant-expressible promoter. Such a recombinant DNA construct can be used to transform a corn plant cell expressing a transgene encoding one or more CO or COL polypeptides and a transgene encoding one or more MADS-box polypeptides to create a transgenic corn plant with desired traits. In another aspect, desired traits comprise semi-dwarf and improved ear traits as compared to a control corn plant not having the two transgenes and the DNA sequence.

In an aspect, a recombinant DNA construct of the present disclosure comprises a DNA sequence encoding one or more CO or COL polypeptides, wherein the DNA sequence is operably linked to a plant-expressible promoter. Such a recombinant DNA construct can be used to transform a corn plant cell having a reduced expression of one or more GA20 oxidase genes and/or one or more GA3 oxidase genes and a transgene encoding one or more MADS-box polypeptides to create a transgenic corn plant with desired traits. In another aspect, desired traits comprise semi-dwarf and improved ear traits as compared to a control corn plant not having the DNA sequence, the transgene, and the reduced expression of the one or more GA20 oxidase genes and/or GA3 oxidase genes.

In an aspect, a recombinant DNA construct of the present disclosure comprises a DNA sequence encoding one or more MADS-box polypeptides, wherein the DNA sequence is operably linked to a plant-expressible promoter. Such a recombinant DNA construct can be used to transform a corn plant cell having a reduced expression of one or more GA20 oxidase genes and/or one or more GA3 oxidase genes and a transgene encoding one or more CO or COL polypeptides to create a transgenic corn plant with desired traits. In another aspect, desired traits comprise semi-dwarf and improved ear traits as compared to a control corn plant not having the DNA sequence, the transgene, and the reduced expression of the one or more GA20 oxidase genes and/or GA3 oxidase genes.

Also provided in the present disclosure is a transgenic corn plants comprising the recombinant DNA construct. In an aspect, the first and second DNA sequences are in a single T-DNA molecule. In another aspect, the first and second DNA sequences are in two different T-DNA molecules. In an aspect, the first transcribable DNA sequence is operably linked to a plant-expressible promoter.

In an aspect, a recombinant DNA construct of the present disclosure comprises a transcribable DNA sequence encoding a non-coding RNA molecule, wherein the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein, the endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NO: 9, 12, 15, 30 and/or 33, and wherein the transcribable DNA sequence is operably linked to a plant-expressible promoter. In another aspect, the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NO: 7, 8, 10, 11, 13, 14, 28, 29, 31 and/or 32.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA20 oxidase protein, the endogenous GA20 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 15. In yet another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 13 or SEQ ID NO: 14.

In another aspect, the non-coding RNA molecule comprises a sequence that is (i) at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA20 oxidase protein, the endogenous GA20 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 9; and/or (ii) at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA20 oxidase protein, the endogenous GA20 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 15.

In another aspect, the non-coding RNA molecule comprises a sequence that is (i) at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7 or 8; and/or (ii) at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 13 or 14.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA20 oxidase protein, the endogenous GA20 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 12.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 10 or 11.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA3 oxidase protein, the endogenous GA3 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 30 or 33.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 28, 29, 31 or 32.

In an aspect, a recombinant DNA construct of the present disclosure comprises a transcribable DNA sequence encoding a non-coding RNA molecule, wherein the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein, the endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or both of SEQ ID NO: 9 and/or 15, and wherein the transcribable DNA sequence is operably linked to a plant-expressible promoter.

In another aspect, the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NO: 7, 8, 13, and/or 14.

In an aspect, the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein, the endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 3, 6, 9, 12, 15, 18, 21, 24, 27, 30 and 33.

In another aspect, the non-coding RNA molecule comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 1, 2, 4, 5, 7, 8, 10, 11, 13, 14, 16, 17, 19, 20, 22, 23, 25, 26, 28, 29, 31, and 32.

In an aspect, a recombinant DNA molecule, vector or construct is provided for suppression of an endogenous GA oxidase (or GA oxidase-like) gene in a corn or cereal plant, the recombinant DNA molecule, vector or construct comprising a transcribable DNA sequence encoding a non-coding RNA molecule, wherein the non-coding RNA molecule comprises a sequence that is (i) at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of any one or more of SEQ ID NO: 84, 85, 87, 88, 89, 91, 92, 93, 95, 96, 98, 99, 100, 102, 103, 105, 106, 107, 109, 110, 111, 113, 114, 115, 117, 119, 120, 122, 123, 124, 126, 127, 128, 130, 131, 132, 134, 135, and/or 137, and/or (ii) at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding a protein in the cereal plant that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to any one or more of SEQ ID NO: 86, 90, 94, 97, 101, 104, 108, 112, 116, 118, 121, 125, 129, 133, and/or 136. Likewise, a non-coding RNA molecule can target an endogenous GA oxidase (or GA oxidase-like) gene in a cereal plant having a percent identity to the GA oxidase gene(s) shown to affect plant height in corn. Thus, a non-coding RNA molecule is further provided comprising a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous protein in a cereal plant that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to any one or more of SEQ ID NO: 9, 12, 15, 30, and/or 33. As mentioned above, the non-coding RNA molecule can target an exon, intron and/or UTR sequence of a GA oxidase (or GA oxidase-like) gene.

A recombinant DNA construct of the present disclosure can comprise or be included within a DNA transformation vector for use in transformation of a target plant cell, tissue or explant. Such a transformation vector of the present disclosure can generally comprise sequences or elements necessary or beneficial for effective transformation in addition to at least one selectable marker gene, at least one expression cassette and/or transcribable DNA sequence encoding one or more site-specific nucleases, and, optionally, one or more sgRNAs or crRNAs.

According to an aspect of the present disclosure, suitable tissue-specific or tissue preferred promoters can include those promoters that drive or cause expression of its associated suppression element or sequence at least in the vascular and/or leaf tissue(s) of a corn or cereal plant, or possibly other tissues.

Expression of the GA oxidase suppression element or construct with a tissue-specific or tissue-preferred promoter can also occur in other tissues of the cereal or corn plant outside of the vascular and leaf tissues, but active GA levels in the developing reproductive tissues of the plant (particularly in the female reproductive organ or ear) are preferably not significantly reduced or impacted (relative to wild type or control plants), such that development of the female organ or ear can proceed normally in the transgenic plant without off-types in the ear and a loss in yield potential.

According to some aspects, constructs and transgenes are provided comprising the a transcribable DNA sequence encoding a non-coding RNA molecule targeting a GA3 oxidase and/or GA20 oxidase gene(s) for suppression and operably linked to a first plant-expressible promoter, a second DNA sequence encoding a COL or CO polypeptide and operably linked to a second plant-expressible promoter, and a third DNA sequence encoding a MADS-box polypeptide and operably linked to a third plant-expressible promoter. The first plant-expressible promoter can be a constitutive or tissue-specific or tissue-preferred promoter, such as a vascular or leaf promoter. The second plant-expressible promoter can be a constitutive or tissue-specific or tissue-preferred promoter, such as a vascular promoter, a leaf promoter, a meristem promoter, or a seed/kernel promoter. The third plant-expressible promoter can be a constitutive or tissue-specific or tissue-preferred promoter, such as a vascular promoter, a root promoter, a meristem promoter, or a seed/kernel promoter.

In an aspect, a plant-expressible promoter is a vascular promoter. Any vascular promoters known in the art can potentially be used as the tissue-specific or tissue-preferred promoter. Examples of vascular promoters include the RTBV promoter, a known sucrose synthase gene promoter, such as a corn sucrose synthase-1 (Sus1 or Sh1) promoter, a corn Sh1 gene paralog promoter, a barley sucrose synthase promoter (Ss1) promoter, a rice sucrose synthase-1 (RSs1) promoter, or a rice sucrose synthase-2 (RSs2) promoter, a known sucrose transporter gene promoter, such as a rice sucrose transporter promoter (SUT1), or various known viral promoters, such as a Commelina yellow mottle virus (CoYMV) promoter, a wheat dwarf geminivirus (WDV) large intergenic region (LIR) promoter, a maize streak geminivirus (MSV) coat protein (CP) promoter, or a rice yellow stripe 1 (YS1)-like or OsYSL2 promoter, and any functional sequence portion or truncation of any of the foregoing promoters with a similar pattern of expression, such as a truncated RTBV promoter.

In another aspect, a vascular promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NO: 67, SEQ ID NO: 68, SEQ ID NO: 69, SEQ ID NO: 70, or SEQ ID NO: 71, or a functional portion thereof.

In another aspect, a plant-expressible promoter is a rice tungro bacilliform virus (RTBV) promoter. In an aspect, the RTBV promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NO: 65 or SEQ ID NO: 66, or a functional portion thereof.

In another aspect, a plant-expressible promoter is a leaf promoter. Any leaf promoters known in the art can potentially be used as the tissue-specific or tissue-preferred promoter. Examples of leaf promoters include a corn pyruvate phosphate dikinase or PPDK promoter, a corn fructose 1,6 bisphosphate aldolase or FDA promoter, and a rice Nadh-Gogat promoter, and any functional sequence portion or truncation of any of the foregoing promoters with a similar pattern of expression. Other examples of leaf promoters from monocot plant genes include a ribulose biphosphate carboxylase (RuBisCO) or RuBisCO small subunit (RBCS) promoter, a chlorophyll a/b binding protein gene promoter, a phosphoenolpyruvate carboxylase (PEPC) promoter, and a Myb gene promoter, and any functional sequence portion or truncation of any of these promoters with a similar pattern of expression.

In another aspect, a leaf promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NO: 72, SEQ ID NO: 73 or SEQ ID NO: 74, or a functional portion thereof.

In another aspect, a plant-expressible promoter is a constitutive promoter. Examples of constitutive promoters that can be used in monocot plants, such as cereal or corn plants, include, for example, various actin gene promoters, such as a rice Actin 1 promoter (see, e.g., U.S. Pat. No. 5,641,876) and a rice Actin 2 promoter (see, e.g., U.S. Pat. No. 6,429,357), a CaMV 35S or 19S promoter (see, e.g., U.S. Pat. No. 5,352,605), a maize ubiquitin promoter (see, e.g., U.S. Pat. No. 5,510,474), a *Coix lacryma-jobi* polyubiquitin promoter, a rice or maize Gos2 promoter (see, e.g., Pater et al., *Plant J.*, 2(6): 837-44 1992), a FMV 35S promoter (see, e.g., U.S. Pat. No. 6,372,211), a dual enhanced CMV promoter (see, e.g., U.S. Pat. No. 5,322,938), a MMV promoter (see, e.g., U.S. Pat. No. 6,420,547), a PCLSV promoter (see, e.g., U.S. Pat. No. 5,850,019), an Emu promoter (see, e.g., Last et al., *Theor. Appl. Genet.*, 81:581 (1991); and Mcelroy et al., *Mol. Gen. Genet.*, 231:150 (1991)), a tubulin promoter from maize, rice or other species, a nopaline synthase (nos) promoter, an octopine synthase (ocs) promoter, a mannopine synthase (mas) promoter, or a plant alcohol dehydrogenase (e.g., maize Adh1) promoter, any other promoters including viral promoters known or later-identified in the art to provide constitutive expression in a cereal or corn plant, any other constitutive promoters known in the art that can be used in monocot or cereal plants, and any functional sequence portion or truncation of any of the foregoing promoters.

In another aspect, the constitutive promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 75, SEQ ID NO: 76, SEQ ID NO: 77, SEQ ID NO: 78, SEQ ID NO: 79, SEQ ID NO: 80, SEQ ID NO: 81, SEQ ID NO: 82 or SEQ ID NO: 83, or a functional portion thereof.

Tissue-specific and tissue-preferred promoters that drive, etc., a moderate or strong level of expression of their associated transcribable DNA sequence in active GA-producing tissue(s) of a plant can be preferred for expression of a GA oxidase suppression element. Furthermore, such tissue-specific and tissue-preferred should drive, etc., expression of their associated transcribable DNA sequence during one or more vegetative stage(s) of plant development when the plant is growing and/or elongating including one or more of the following vegetative stage(s): $V_E$, V1, V2, V3, V4, V5, V6, V7, V8, V9, V10, V11, V12, V13, V14, Vn, $V_T$, such as expression at least during V3-V12, V4-V12, V5-V12, V6-V12, V7-V12, V8-V12, V3-V14, V5-V14, V6-V14, V7-V14, V8-V14, V9-V14, V10-V14, etc., or during any other range of vegetative stages when growth and/or elongation of the plant is occurring.

According to an aspect, the plant-expressible promoter operably linked to a GA oxidase suppression element can preferably drive expression constitutively or in at least a portion of the vascular and/or leaf tissues of the plant. Different promoters driving expression of a suppression element targeting the endogenous GA20 oxidase_3 and/or GA20 oxidase_5 gene(s), the GA20 oxidase_4 gene, the GA3 oxidase_1 and/or GA3 oxidase_2 gene(s) in corn, or similar genes and homologs in other cereal plants, can be effective at reducing plant height and increasing lodging resistance to varying degrees depending on their particular pattern and strength of expression in the plant. However, some tissue-specific and tissue-preferred promoters driving expression of a GA20 or GA3 oxidase suppression element in a plant may not produce a short stature or anti-lodging phenotypes due to the spatial-temporal pattern of expression of the promoter during plant development, and/or the amount or strength of expression of the promoter being too low or weak. Furthermore, some suppression constructs can only reduce and not eliminate expression of the targeted GA20 or GA3 oxidase gene(s) when expressed in a plant, and thus depending on the pattern and strength of expression with a given promoter, the pattern and level of expression of the GA20 or GA3 oxidase suppression construct with such a promoter may not be sufficient to produce an observable plant height and lodging resistance phenotype in plants.

Any vascular and/or leaf promoters known in the art can be used for expression of a GA oxidase suppression element, including promoter sequences from related genes (e.g., sucrose synthase, sucrose transporter, and viral gene promoter sequences) from the same or different plant species or virus that have a similar pattern of expression. Further provided are promoter sequences with a high degree of homology to any of the foregoing. Examples of vascular and/or leaf promoters can further include other known, engineered and/or later-identified promoter sequences shown to have a pattern of expression in vascular and/or leaf tissue(s) of a cereal or corn plant. Furthermore, any known or later-identified constitutive promoter can also be used for expression of a GA20 oxidase or GA3 oxidase suppression element.

According to some aspects, recombinant expression cassettes, constructs, transgenes, and recombinant DNA donor template molecules are provided comprising a DNA sequence encoding a CO or COL polypeptide operably linked to a constitutive promoter, a vascular promoter, a leaf promoter, a meristem promoter, or a seed or kernel promoter. According to some aspects, recombinant expression cassettes, constructs, transgenes, and recombinant DNA donor template molecules are provided comprising a DNA sequence encoding a MADS-box polypeptide operably linked to a constitutive promoter, a vascular promoter, a root promoter, a meristem promoter, or a seed or kernel promoter. For a review or resource of some promoter types and examples available in the art, see, e.g., Lagrimini, L. M. (editor), Maize: Methods and Protocols (Humana Press), Chapter 4: A Brief History of Promoter Development for Use in Transgenic Maize Applications, Vol. 1676, pp. 61-93 (2017); and the Maize Cell Genomics Database (maize[dot] jcvi[dot]org/cellgenomics/index[dot]php), the entire contents and disclosures of which are incorporated herein by reference.

In an aspect, a DNA sequence encoding a CO or COL polypeptide is operably linked to a meristem promoter, such as a meristem-specific promoter or a meristem-preferred promoter. In an aspect, a DNA sequence encoding a MADS-box polypeptide is operably linked to a meristem promoter, such as a meristem-specific promoter or a meristem-preferred promoter. In one aspect, a meristem promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or both of SEQ ID NOs: 484 and 485, or a functional portion thereof.

In an aspect, a DNA sequence encoding a CO or COL polypeptide is operably linked to a seed or kernel promoter, such as a seed- or kernel-specific promoter or a seed- or kernel-preferred promoter. In an aspect, a DNA sequence encoding a MADS-box polypeptide is operably linked to a seed or kernel promoter, such as a seed- or kernel-specific promoter or a seed- or kernel-preferred promoter. In one aspect, a seed promoter or a kernel promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 486-491, or a functional portion thereof.

In an aspect, a DNA sequence encoding a MADS-box polypeptide is operably linked to a root promoter, such as a root-specific or root-preferred promoter. Such a root promoter can confer transcription in root tissue, e.g., root endodermis, root epidermis, and/or root vascular tissues.

In addition to its associated promoter, a transcribable DNA sequence or a transgene can also be operatively linked to one or more additional regulatory element(s), such as an enhancer(s), leader, transcription start site (TSS), linker, 5' and 3' untranslated region(s) (UTRs), intron(s), polyadenylation signal, termination region or sequence, etc., that are suitable, necessary or preferred for strengthening, regulating or allowing expression of the transcribable DNA sequence in a plant cell. Such additional regulatory element(s) can be optional and/or used to enhance or optimize expression of the transgene or transcribable DNA sequence. As provided herein, an "enhancer" can be distinguished from a "promoter" in that an enhancer typically lacks a transcription start site, TATA box, or equivalent sequence and is thus insufficient alone to drive transcription. As used herein, a "leader" can be defined generally as the DNA sequence of the 5'-UTR of a gene (or transgene) between the transcription start site (TSS) and 5' end of the transcribable DNA sequence or protein coding sequence start site of the transgene.

In an aspect, the coding sequence for a CO or COL polypeptide or the coding sequence for a MADS-box polypeptide comprised in a recombinant DNA construct of the present application is operably linked to a plant-expressible promoter, such as a constitutive or tissue-specific promoter. According to an aspect, the plant-expressible promoter is a medium or high-constitutive promoter with a high-constitutive promoter having a relatively more robust or strong constitutive expression. In an aspect, the plant-expressible promoter is a constitutive promoter, which can be selected from the group consisting of an actin promoter, a Cauliflower mosaic virus (CaMV) 35S or 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, or a maize alcohol dehydrogenase, a functional portion thereof, and a combination thereof.

In an aspect, a transformation vector comprising the recombinant DNA construct is produced. In another aspect, a transgenic corn plant or a plant part thereof comprising the recombinant DNA construct is produced. In still another aspect, the transgenic corn plant is semi-dwarf and has one or more improved ear traits, relative to a control corn plant not having both the first transcribable DNA sequence and the second DNA sequence.

A recombinant DNA molecule or construct of the present disclosure can comprise or be included within a DNA transformation vector for use in transformation of a target plant cell, tissue or explant. Such a transformation vector can generally comprise sequences or elements necessary or beneficial for effective transformation in addition to at least one transgene, expression cassette and/or transcribable DNA sequence.

For *Agrobacterium*-mediated, *Rhizobia*-mediated or other bacteria-mediated transformation, the transformation vector can comprise an engineered transfer DNA (or T-DNA) segment or region having two border sequences, a left border (LB) and a right border (RB), flanking at least a transcribable DNA sequence or transgene, such that insertion of the T-DNA into the plant genome will create a transformation event for the transcribable DNA sequence, transgene or expression cassette. Thus, a transcribable DNA sequence, transgene or expression cassette can be located between the left and right borders of the T-DNA, perhaps along with an additional transgene(s) or expression cassette(s), such as a plant selectable marker transgene and/or other gene(s) of agronomic interest that can confer a trait or phenotype of agronomic interest to a plant. According to alternative aspects, the transcribable DNA sequence, transgene or expression cassette encoding a non-coding RNA molecule targeting an endogenous GA oxidase gene for suppression and the plant selectable marker transgene (or other gene of agronomic interest) can be present in separate T-DNA segments on the same or different recombinant DNA molecule(s), such as for co-transformation. A transformation vector or construct can further comprise prokaryotic maintenance elements, which can be located in the vector outside of the T-DNA region(s).

The present disclosure provides a modified corn plant with a semi-dwarf phenotype and one or more improved ear traits relative to a control plant. The modified corn plant has its expression of one or more GA20 oxidase genes and/or one or more GA3 oxidase genes reduced and comprises a transgene expressing one or more CO or COL polypeptides and a transgene expressing one or more MADS-box polypeptides. In an aspect, the reduced expression of the one or more GA20 oxidase genes and/or one or more GA3 oxidase genes is caused by a mutation or edit at or near the one or more GA20 oxidase genes and/or GA3 oxidase genes introduced via genome editing. In another aspect, the reduced expression of one or more GA20 oxidase genes and/or one or more GA3 oxidase genes is caused by a site-directed integration of a transcribable DNA sequence encoding a non-coding RNA for suppression of the one or more GA20 oxidase genes and/or one or more GA3 oxidase genes. In an aspect, the site-directed integration is mediated by genome editing. In an aspect, the introduction of the transgene expressing one or more CO or COL polypeptides and the transgene expressing one or more MADS-box polypeptides is caused by a site-directed integration of a sequence comprising the transgene. In another aspect, the site-directed integration is mediated by genome editing.

In an aspect, a genome editing system provided herein comprises a CRISPR system. The CRISPR systems are based on RNA-guided engineered nucleases that use complementary base pairing to recognize DNA sequences at target sites. In an aspect, a vector provided herein can comprise any combination of a nucleic acid sequence encoding a RNA-guided nuclease.

In an aspect, a method and/or composition provided herein comprises one or more, two or more, three or more, four or more, or five or more Cas9 nucleases. In an aspect, a method and/or composition provided herein comprises one or more polynucleotides encoding one or more, two or more, three or more, four or more, or five or more Cas9 nucleases. In another aspect, a Cas9 nuclease provided herein is capable of generating a targeted DSB. In an aspect, a method and/or composition provided herein comprises one or more, two or more, three or more, four or more, or five or more Cpf1 nucleases. In an aspect, a method and/or composition provided herein comprises one or more polynucleotides encoding one or more, two or more, three or more, four or more, or five or more Cpf1 nucleases. In another aspect, a Cpf1 nuclease provided herein is capable of generating a targeted DSB.

In an aspect, a vector or construct provided herein comprises polynucleotides encoding at least 1, at least 2, at least 3, at least 4, at least 5, at least 6, at least 7, at least 8, at least 9, or at least 10 site-specific nuclease. In another aspect, a cell provided herein already comprises a site-specific nuclease. In an aspect, a polynucleotide encoding a site-specific nuclease provided herein is stably transformed into a cell. In another aspect, a polynucleotide encoding a site-specific nuclease provided herein is transiently transformed into a cell. In another aspect, a polynucleotide encoding a site-specific nuclease is under the control of a regulatable promoter, a constitutive promoter, a tissue specific promoter, or any promoter useful for expression of the site-specific nuclease.

In an aspect, vectors comprising polynucleotides encoding a site-specific nuclease, and optionally one or more, two or more, three or more, or four or more sgRNAs are provided to a plant cell by transformation methods known in the art (e.g., without being limiting, particle bombardment, PEG-mediated protoplast transfection or *Agrobacterium*-mediated transformation), In an aspect, vectors comprising polynucleotides encoding a Cas9 nuclease, and optionally one or more, two or more, three or more, or four or more sgRNAs are provided to a plant cell by transformation methods known in the art (e.g., without being limiting, particle bombardment, PEG-mediated protoplast transfection or *Agrobacterium*-mediated transformation). In another aspect, vectors comprising polynucleotides encoding a Cpf1 and, optionally one or more, two or more, three or more, or four or more crRNAs are provided to a cell by transformation methods known in the art (e.g., without being limiting, viral transfection, particle bombardment, PEG-mediated protoplast transfection or *Agrobacterium*-mediated transformation).

In an aspect, a vector comprises in cis a cassette encoding a site-specific nuclease and an insertion sequence such that when contacted with the genome of a cell, the site-specific nuclease enables site-specific integration of the insertion sequence. In an aspect, a first vector comprises a cassette encoding a site-specific nuclease and a second vector comprises an insertion sequence such that when contacted with the genome of a cell, the site-specific nuclease provided in trans enables site-specific integration of the insertion sequence.

Site-specific nucleases provided herein can be used as part of a targeted editing technique. Non-limiting examples of site-specific nucleases used in methods and/or compositions provided herein include meganucleases, zinc finger nucleases (ZFNs), transcription activator-like effector nucleases (TALENs), RNA-guided nucleases (e.g., Cas9 and Cpf1), a recombinase (without being limiting, for example, a serine recombinase attached to a DNA recognition motif, a tyrosine recombinase attached to a DNA recognition motif), a transposase (without being limiting, for example, a DNA transposase attached to a DNA binding domain), or any combination thereof. In an aspect, a method provided herein comprises the use of one or more, two or more, three or more, four or more, or five or more site-specific nucleases to induce one, two, three, four, five, or more than five DSBs at one, two, three, four, five, or more than five target sites.

In an aspect, a genome editing system provided herein (e.g., a meganuclease, a ZFN, a TALEN, a CRISPR/Cas9 system, a CRISPR/Cpf1 system, a recombinase, a transposase), or a combination of genome editing systems provided herein, is used in a method to introduce one or more insertions, deletions, substitutions, or inversions to a locus in a cell to introduce a mutation, or generate a dominant negative allele or a dominant positive allele.

Site-specific nucleases, such as meganucleases, ZFNs, TALENs, Argonaute proteins (non-limiting examples of Argonaute proteins include *Thermus thermophilus* Argonaute (TtAgo), *Pyrococcus furiosus* Argonaute (PfAgo), *Natronobacterium gregoryi* Argonaute (NgAgo), homologs thereof, or modified versions thereof), Cas9 nucleases (non-limiting examples of RNA-guided nucleases include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1 (or Cas12a), homologs thereof, or modified versions thereof), induce a double-strand DNA break at the target site of a genomic sequence that is then repaired by the natural processes of HR or NHEJ. Sequence modifications then occur at the cleaved sites, which can include inversions, deletions, or insertions that result in gene disruption in the case of NHEJ, or integration of nucleic acid sequences by HR.

In an aspect, a site-specific nuclease provided herein is selected from the group consisting of a zinc-finger nuclease, a meganuclease, an RNA-guided nuclease, a TALE-nuclease, a recombinase, a transposase, or any combination thereof. In another aspect, a site-specific nuclease provided herein is selected from the group consisting of a Cas9 or a Cpf1.

In another aspect a site-specific nuclease provided herein is selected from the group consisting of a Cas1, a Cas1B, a Cas2, a Cas3, a Cas4, a Cas5, a Cas6, a Cas7, a Cas8, a Cas9, a to Cas10, a Csy1, a Csy2, a Csy3, a Cse1, a Cse2, a Csc1, a Csc2, a Csa5, a Csn2, a Csm2, a Csm3, a Csm4, a Csm5, a Csm6, a Cmr1, a Cmr3, a Cmr4, a Cmr5, a Cmr6, a Csb1, a Csb2, a Csb3, a Csx17, a Csx14, a Csx10, a Csx16, a CsaX, a Csx3, a Csx1, a Csx15, a Csf1, a Csf2, a Csf3, a Csf4, a Cpf1 (or Cas12a), a homolog thereof, or a modified version thereof. In another aspect, an RNA-guided nuclease provided herein is selected from the group consisting of a Cas9 or a Cpf1.

In another aspect an RNA guided nuclease provided herein is selected from the group consisting of a Cas1, a Cas1B, a Cas2, a Cas3, a Cas4, a Cas5, a Cas6, a Cas7, a Cas8, a Cas9, a Cas10, a Csy1, a Csy2, a Csy3, a Cse1, a Cse2, a Csc1, a Csc2, a Csa5, a Csn2, a Csm2, a Csm3, a Csm4, a Csm5, a Csm6, a Cmr1, a Cmr3, a Cmr4, a Cmr5, a Cmr6, a Csb1, a Csb2, a Csb3, a Csx17, a Csx14, a Csx10, a Csx16, a CsaX, a Csx3, a Csx1, a Csx15, a Csf1, a Csf2, a Csf3, a Csf4, a Cpf1 (or Cas12a), a homolog thereof, or a modified version thereof.

In another aspect, a method and/or a composition provided herein comprises at least one, at least two, at least three, at least four, at least five, at least six, at least seven, at least eight, at least nine, or at least ten site-specific nucleases. In yet another aspect, a method and/or a composition provided herein comprises at least one, at least two, at least three, at least four, at least five, at least six, at least seven, at least eight, at least nine, or at least ten polynucleotides encoding at least one, at least two, at least three, at least four, at least five, at least six, at least seven, at least eight, at least nine, or at least ten site-specific nucleases.

In an aspect, an RNA-guided nuclease provided herein is selected from the group consisting of Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1 (or Cas12a), homologs thereof, or modified versions thereof, an Argonaute (non-limiting examples of Argonaute proteins include *Thermus thermophilus* Argonaute (TtAgo), *Pyrococcus furiosus* Argonaute (PfAgo), *Natronobacterium gregoryi* Argonaute (NgAgo), homologs thereof, modified versions thereof), a DNA guide for an Argonaute protein, and any combination thereof. In another aspect, an RNA-guided nuclease provided herein is selected from the group consisting of Cas9 and Cpf1.

In another aspect, an RNA-guided nuclease provided herein comprises Cas9. In an aspect, an RNA-guided nuclease provided herein is selected from the group consisting of Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1 (or Cas12a), homologs thereof, or modified versions thereof. In an aspect a site-specific nuclease is selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, TtAgo, PfAgo, and NgAgo. In another aspect, an RNA-guided nuclease is selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, TtAgo, PfAgo, and NgAgo.

A target site can be positioned in a polynucleotide sequence encoding a leader, an enhancer, a transcriptional start site, a promoter, a 5'-UTR, an exon, an intron, a 3'-UTR, a polyadenylation site, or a termination sequence. It will be appreciated that a target site can also be positioned upstream or downstream of a sequence encoding a leader, an enhancer, a transcriptional start site, a promoter, a 5'-UTR, an exon, an intron, a 3'-UTR, a polyadenylation site, or a termination sequence. In an aspect, a target site is positioned within 10, within 20, within 30, within 40, within 50, within 75, within 100, within 125, within 150, within 200, within 250, within 300, within 400, within 500, within 600, within 700, within 800, within 900, within 1000, within 1250, within 1500, within 2000, within 2500, within 5000, within 10,000, or within 25,000 nucleotides of a polynucleotide encoding a leader, an enhancer, a transcriptional start site, a promoter, a 5'-UTR, an exon, an intron, a 3'-UTR, a polyadenylation site, a gene, or a termination sequence.

In an aspect, a target site bound by an RNA-guided nuclease is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of SEQ ID NO: 34, 35, 36, 37, or 38, or a sequence complementary thereto.

In an aspect, a targeted genome editing technique described herein can comprise the use of a recombinase. In an aspect, a tyrosine recombinase attached to a DNA recognition motif is selected from the group consisting of a Cre recombinase, a Gin recombinase a Flp recombinase, and a Tnp1 recombinase. In an aspect, a Cre recombinase or a Gin recombinase provided herein is tethered to a zinc-finger DNA binding domain. The Flp-FRT site-directed recombination system comes from the 2μ plasmid from the baker's yeast Saccharomyces cerevisiae. In this system, Flp recombinase (flippase) recombines sequences between flippase recognition target (FRT) sites. FRT sites comprise 34 nucleotides. Flp binds to the "arms" of the FRT sites (one arm is in reverse orientation) and cleaves the FRT site at either end of an intervening nucleic acid sequence. After cleavage, Flp recombines nucleic acid sequences between two FRT sites. Cre-lox is a site-directed recombination system derived from the bacteriophage P1 that is similar to the Flp-FRT recombination system. Cre-lox can be used to invert a nucleic acid sequence, delete a nucleic acid sequence, or translocate a nucleic acid sequence. In this system, Cre recombinase recombines a pair of lox nucleic acid sequences. Lox sites comprise 34 nucleotides, with the first and last 13 nucleotides (arms) being palindromic. During recombination, Cre recombinase protein binds to two lox sites on different nucleic acids and cleaves at the lox sites. The cleaved nucleic acids are spliced together (reciprocally translocated) and recombination is complete. In another aspect, a lox site provided herein is a loxP, lox 2272, loxN, lox 511, lox 5171, lox71, lox66, M2, M3, M7, or M11 site.

In another aspect, a serine recombinase attached to a DNA recognition motif provided herein is selected from the group consisting of a PhiC31 integrase, an R4 integrase, and a TP-901 integrase. In another aspect, a DNA transposase attached to a DNA binding domain provided herein is selected from the group consisting of a TALE-piggyBac and TALE-Mutator.

Several site-specific nucleases, such as recombinases, zinc finger nucleases (ZFNs), meganucleases, and TALENs, are not RNA-guided and instead rely on their protein structure to determine their target site for causing the DSB or nick, or they are fused, tethered or attached to a DNA-binding protein domain or motif.

ZFNs are synthetic proteins consisting of an engineered zinc finger DNA-binding domain fused to the cleavage domain of the FokI restriction nuclease. ZFNs can be designed to cleave almost any long stretch of double-stranded DNA for modification of the zinc finger DNA-binding domain. ZFNs form dimers from monomers composed of a non-specific DNA cleavage domain of FokI nuclease fused to a zinc finger array engineered to bind a target DNA sequence.

DNA-binding domain of a ZFN is typically composed of 3-4 zinc-finger arrays. The amino acids at positions −1, +2, +3, and +6 relative to the start of the zinc finger ∞-helix, which contribute to site-specific binding to the target DNA, can be changed and customized to fit specific target sequences. The other amino acids form the consensus backbone to generate ZFNs with different sequence specificities. Rules for selecting target sequences for ZFNs are known in the art.

FokI nuclease domain requires dimerization to cleave DNA and therefore two ZFNs with their C-terminal regions are needed to bind opposite DNA strands of the cleavage site (separated by 5-7 bp). The ZFN monomer can cut the target site if the two-ZF-binding sites are palindromic. The term ZFN, as used herein, is broad and includes a monomeric ZFN that can cleave double stranded DNA without assistance from another ZFN. The term ZFN is also used to refer to one or both members of a pair of ZFNs that are engineered to work together to cleave DNA at the same site.

Without being limited by any scientific theory, because the DNA-binding specificities of zinc finger domains can be re-engineered using one of various methods, customized ZFNs can theoretically be constructed to target nearly any target sequence (e.g., at or near a GA oxidase gene in a plant genome). Publicly available methods for engineering zinc finger domains include Context-dependent Assembly (CoDA), Oligomerized Pool Engineering (OPEN), and Modular Assembly. In an aspect, a method and/or composition provided herein comprises one or more, two or more, three or more, four or more, or five or more ZFNs. In another aspect, a ZFN provided herein is capable of generating a targeted DSB or nick. In an aspect, vectors comprising polynucleotides encoding one or more, two or more, three or more, four or more, or five or more ZFNs are provided to a cell by transformation methods known in the art (e.g., without being limiting, viral transfection, particle bombardment, PEG-mediated protoplast transfection, or *Agrobacterium*-mediated transformation). The ZFNs can be introduced as ZFN proteins, as polynucleotides encoding ZFN proteins, and/or as combinations of proteins and protein-encoding polynucleotides.

In an aspect, a method and/or composition provided herein comprises one or more, two or more, three or more, four or more, or five or more ZFNs. In another aspect, a ZFN provided herein is capable of generating a targeted DSB. In an aspect, vectors comprising polynucleotides encoding one or more, two or more, three or more, four or more, or five or more ZFNs are provided to a cell by transformation methods known in the art (e.g., without being limiting, viral transfection, particle bombardment, PEG-mediated protoplast transfection or *Agrobacterium*-mediated transformation).

Meganucleases, which are commonly identified in microbes, such as the LAGLIDADG family of homing endonucleases, are unique enzymes with high activity and long recognition sequences (>14 bp) resulting in site-specific digestion of target DNA. Engineered versions of naturally occurring meganucleases typically have extended DNA recognition sequences (for example, 14 to 40 bp). According to some aspects, a meganuclease can comprise a scaffold or base enzyme selected from the group consisting of I-CreI, I-CeuI, I-MsoI, I-SceI, I-AniI, and I-DmoI. The engineering of meganucleases can be more challenging than ZFNs and TALENs because the DNA recognition and cleavage functions of meganucleases are intertwined in a single domain. Specialized methods of mutagenesis and high-throughput screening have been used to create novel meganuclease variants that recognize unique sequences and possess improved nuclease activity. Thus, a meganuclease can be selected or engineered to bind to a genomic target sequence in a plant, such as at or near the genomic locus of a GA oxidase gene. In an aspect, a method and/or composition provided herein comprises one or more, two or more, three or more, four or more, or five or more meganucleases. In another aspect, a meganuclease provided herein is capable of generating a targeted DSB. In an aspect, vectors comprising polynucleotides encoding one or more, two or more, three or more, four or more, or five or more meganucleases are provided to a cell by transformation methods known in the art (e.g., without being limiting, viral transfection, particle bombardment, PEG-mediated protoplast transfection or *Agrobacterium*-mediated transformation).

TALENs are artificial restriction enzymes generated by fusing the transcription activator-like effector (TALE) DNA binding domain to a FokI nuclease domain. When each member of a TALEN pair binds to the DNA sites flanking a target site, the FokI monomers dimerize and cause a double-stranded DNA break at the target site. Besides the wild-type FokI cleavage domain, variants of the FokI cleavage domain with mutations have been designed to improve cleavage specificity and cleavage activity. The FokI domain functions as a dimer, requiring two constructs with unique DNA binding domains for sites in the target genome with proper orientation and spacing. Both the number of amino acid residues between the TALEN DNA binding domain and the FokI cleavage domain and the number of bases between the two individual TALEN binding sites are parameters for achieving high levels of activity.

TALENs are artificial restriction enzymes generated by fusing the transcription activator-like effector (TALE) DNA binding domain to a nuclease domain. In some aspects, the nuclease is selected from a group consisting of PvuII, MutH, TevI and FokI, AlwI, MlyI, SW, SdaI, StsI, CleDORF, Clo051, Pept071. When each member of a TALEN pair binds to the DNA sites flanking a target site, the FokI monomers dimerize and cause a double-stranded DNA break at the target site.

The term TALEN, as used herein, is broad and includes a monomeric TALEN that can cleave double stranded DNA without assistance from another TALEN. The term TALEN is also used to refer to one or both members of a pair of TALENs that work together to cleave DNA at the same site.

Transcription activator-like effectors (TALEs) can be engineered to bind practically any DNA sequence. TALE proteins are DNA-binding domains derived from various plant bacterial pathogens of the genus *Xanthomonas*. The X pathogens secrete TALEs into the host plant cell during infection. The TALE moves to the nucleus, where it recognizes and binds to a specific DNA sequence in the promoter region of a specific DNA sequence in the promoter region of a specific gene in the host genome. TALE has a central DNA-binding domain composed of 13-28 repeat monomers of 33-34 amino acids. The amino acids of each monomer are highly conserved, except for hypervariable amino acid residues at positions 12 and 13. The two variable amino acids are called repeat-variable diresidues (RVDs). The amino acid pairs NI, NG, HD, and NN of RVDs preferentially recognize adenine, thymine, cytosine, and guanine/adenine, respectively, and modulation of RVDs can recognize consecutive DNA bases. This simple relationship between amino acid sequence and DNA recognition has allowed for the engineering of specific DNA binding domains by selecting a combination of repeat segments containing the appropriate RVDs.

Besides the wild-type FokI cleavage domain, variants of the FokI cleavage domain with mutations have been designed to improve cleavage specificity and cleavage activity. The FokI domain functions as a dimer, requiring two constructs with unique DNA binding domains for sites in the target genome with proper orientation and spacing. Both the number of amino acid residues between the TALEN DNA binding domain and the FokI cleavage domain and the number of bases between the two individual TALEN binding sites are parameters for achieving high levels of activity. PvuII, MutH, and TevI cleavage domains are useful alternatives to FokI and FokI variants for use with TALEs. PvuII functions as a highly specific cleavage domain when coupled to a TALE (see Yank et al. 2013. *PLoS One.* 8: e82539). MutH is capable of introducing strand-specific nicks in DNA (see Gabsalilow et al. 2013. *Nucleic Acids Research.* 41: e83). TevI introduces double-stranded breaks in DNA at targeted sites (see Beurdeley et al., 2013. Nature Communications. 4: 1762).

The relationship between amino acid sequence and DNA recognition of the TALE binding domain allows for designable proteins. Software programs such as DNA Works can be used to design TALE constructs. Other methods of designing TALE constructs are known to those of skill in the art. See Doyle et al., *Nucleic Acids Research* (2012) 40: W117-122; Cermak et al., *Nucleic Acids Research* (2011). 39:e82; and tale-nt.cac.cornell.edu/about.

In an aspect, a method and/or composition provided herein comprises one or more, two or more, three or more, four or more, or five or more TALENs. In another aspect, a TALEN provided herein is capable of generating a targeted DSB. In an aspect, vectors comprising polynucleotides encoding one or more, two or more, three or more, four or more, or five or more TALENs are provided to a cell by transformation methods known in the art (e.g., without being limiting, viral transfection, particle bombardment, PEG-mediated protoplast transfection or *Agrobacterium*-mediated transformation).

As used herein, a "targeted genome editing technique" refers to any method, protocol, or technique that allows the precise and/or targeted editing of a specific location in a genome of a plant (i.e., the editing is largely or completely non-random) using a site-specific nuclease, such as a meganuclease, a zinc-finger nuclease (ZFN), an RNA-guided endonuclease (e.g., the CRISPR/Cas9 system), a TALE-endonuclease (TALEN), a recombinase, or a transposase.

Provided in the present disclosure is a modified corn plant comprising 1) one or more mutations or edits at or near one or more endogenous GA20 oxidase and/or GA3 oxidase genes, wherein the expression or activity of the one or more endogenous GA20 oxidase and/or GA3 oxidase genes is reduced relative to a wildtype control plant, 2) a first recombinant expression cassette comprising a coding sequence for a CO or COL polypeptide operably linked to a first plant-expressible promoter, and 3) a second recombinant expression cassette comprising a coding sequence for a MADS-box polypeptide operably linked to a second plant-expressible promoter. In an aspect, the modified corn plant is semi-dwarf and has one or more improved ear traits, relative to a control corn plant that does not comprise the one or more mutations or edits and the two recombinant expression cassettes. In another aspect, the one or more mutations or edits are selected from the group consisting of an insertion, a substitution, an inversion, a deletion, a duplication, and a combination thereof. In yet another aspect, the one or more mutations or edits are introduced using a meganuclease, a zinc-finger nuclease (ZFN), a RNA-guided endonuclease, a TALE-endonuclease (TALEN), a recombinase, or a transposase.

Also provided is a plurality of modified corn plants in a field, each modified corn plant comprising 1) one or more mutations or edits at or near one or more endogenous GA20 oxidase and/or GA3 oxidase genes, wherein the expression of the one or more endogenous GA20 oxidase and/or GA3 oxidase genes are reduced relative to a wildtype control plant, 2) a first recombinant expression cassette comprising a coding sequence for a CO or COL polypeptide operably linked to a first plant-expressible promoter, and 3) a second recombinant expression cassette comprising a coding sequence for a MADS-box polypeptide operably linked to a second plant-expressible promoter. In an aspect, the modified corn plants have increased yield relative to control corn plants. In an aspect, the first plant-expressible promoter is a constitutive or tissue-specific promoter. In an aspect, such a tissue-specific promoter operably linked to a DNA sequence encoding a CO or COL polypeptide is a vascular promoter.

In an aspect, such a tissue-specific promoter operably linked to a DNA sequence encoding a CO or COL polypeptide is a leaf promoter. In an aspect, such a tissue-specific promoter operably linked to a DNA sequence encoding a CO or COL polypeptide is a meristem promoter, such as a meristem-specific promoter or a meristem-preferred promoter. In another aspect, such a tissue-specific promoter operably linked to a DNA sequence encoding a CO or COL polypeptide is a kernel or seed promoter, such as a seed-preferred or seed-specific promoter. Examples of a meristem promoter, and a seed or kernel promoter are provided herein. In an aspect, the second plant-expressible promoter is a constitutive or tissue-specific promoter. In an aspect, such a tissue-specific promoter operably linked to a DNA sequence encoding a MADS-box polypeptide is a vascular promoter. In an aspect, such a tissue-specific promoter operably linked to a DNA sequence encoding a MADS-box polypeptide is a root promoter. In an aspect, such a tissue-specific promoter operably linked to a DNA sequence encoding a MADS-box polypeptide is a meristem promoter, such as a meristem-specific promoter or a meristem-preferred promoter. In another aspect, such a tissue-specific promoter operably linked to a DNA sequence encoding a MADS-box polypeptide is a kernel or seed promoter, such as a seed-preferred or seed-specific promoter. Examples of a root promoter, a meristem promoter, and a seed or kernel promoter are provided herein.

In an aspect, such a root promoter is an *Oryza sativa* Rcc3 gene promoter. In an aspect, such a root promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 178, or a functional portion thereof. In an aspect, such a seed or kernel promoter is from a maize putative embryo-specific (Esp) gene promoter.

In another aspect, the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

In an aspect, the modified corn plant is semi-dwarf and has one or more improved ear traits, relative to a control corn plant that does not comprise the mutations or edits and the two recombinant expression cassettes. In an aspect, a genome edited or mutated corn cell is obtained via a CRISPR based genome editing system.

Aspects of the present disclosure further include methods for making or producing modified plants, such as by genome editing, crossing, etc., wherein the method comprises editing the genomic locus of an endogenous GA3 or GA20 oxidase gene and introducing a transgene encoding one or more CO or COL polypeptides and a transgene encoding one or more MADS-box polypeptides, and then regenerating or developing the modified plant from the edited plant cell.

In an aspect, a method comprises introducing a mutation or edit via CRISPR based genome editing at or near one or more endogenous GA3 or GA20 oxidase genes to reduce the expression of the one or more endogenous GA3 or GA20 oxidase genes. The method comprises creating a double-stranded break (DSB) in the genome of the plant cell, wherein a mutation or edit is introduced therein, thereby reducing the expression of the one or more endogenous GA3 or GA20 oxidase genes. In an aspect, the mutation or edit can be created (or integrated with a donor template) in a targeted manner into the genome of a cell at the location of a DSB via RNA-guided nucleases (e.g., Cas9 and Cpf1). In another aspect, a guide RNA recognizes a target site and acts in association with an RNA-guided nuclease that creates a DSB at the target site, wherein a mutation or edit is created (or integrated with a donor template) into the target site. In another aspect, the target site is near or at one or more endogenous GA3 or GA20 oxidase genes.

In an aspect, a method comprises introducing an insertion sequence encoding one or more CO or COL polypeptides into the genome of a plant cell via site-directed integration. Such a method comprises creating a DSB in the genome of the plant cell such that the insertion sequence is integrated at the site of the DSB. In an aspect, the insertion sequence encoding one or more CO or COL polypeptides can be inserted or integrated in a targeted manner into the genome of a cell at the location of a DSB via RNA-guided nucleases (e.g., Cas9 and Cpf1) in a CRISPR based genome editing system. In another aspect, a guide RNA recognizes a target site and acts in association with an RNA-guided nuclease that creates a double-stranded break at the target site, wherein the insertion sequence encoding one or more CO or COL polypeptides inserts or integrates into the target site.

In an aspect, a method comprises introducing an insertion sequence encoding one or more MADS-box polypeptides into the genome of a plant cell via site-directed integration. Such a method comprises creating a DSB in the genome of the plant cell such that the insertion sequence is integrated at the site of the DSB. In an aspect, the insertion sequence encoding one or more MADS-box polypeptides can be inserted or integrated in a targeted manner into the genome of a cell at the location of a DSB via RNA-guided nucleases (e.g., Cas9 and Cpf1) in a CRISPR based genome editing system. In another aspect, a guide RNA recognizes a target site and acts in association with an RNA-guided nuclease that creates a double-stranded break at the target site, wherein the insertion sequence encoding one or more MADS-box polypeptides inserts or integrates into the target site.

In an aspect, an insertion sequence of a donor template of the present disclosure comprises a DNA sequence encoding a CO or COL polypeptide, wherein the CO or COL polypeptide sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 182-458 and a functional fragment thereof.

In an aspect, an insertion sequence of a donor template of the present disclosure comprises a DNA sequence encoding a PpCOL1 polypeptide, wherein the DNA sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169. In another aspect, an insertion sequence of the present disclosure comprises a DNA sequence encoding a polypeptide comprising an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a polypeptide or amino acid sequence selected from the group consisting of SEQ ID NO: 168, or a functional fragment thereof.

In an aspect, an insertion sequence of a donor template of the present disclosure comprises a DNA sequence encoding a MADS-box polypeptide, wherein the MADS-box polypeptide sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 459-483 and a functional fragment thereof.

In an aspect, an insertion sequence of a donor template of the present disclosure comprises a DNA sequence encoding a maize ZMM19 polypeptide, wherein the DNA sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177. In another aspect, an insertion sequence of the present disclosure comprises a DNA sequence encoding a polypeptide comprising an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a polypeptide or amino acid sequence selected from the group consisting of SEQ ID NO: 176, or a functional fragment thereof.

Provided in the present disclosure is a method for producing a modified corn plant, the method comprising: a) introducing into a corn cell a first recombinant expression cassette comprising a coding sequence for a CO or COL polypeptide operably linked to a first plant-expressible promoter, and wherein the corn cell comprises (1) one or more mutations and/or edits in one or more endogenous GA3 oxidase and/or GA20 oxidase genes and (2) a second recombinant expression cassette comprising a coding sequence for a MADS-box polypeptide operably linked to a second plant-expressible promoter; and b) regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits. In an aspect, the method further comprises introducing a recombinant DNA construct encoding a guide RNA that targets the one or more endogenous GA3 oxidase and/or GA20 oxidase genes.

In another aspect, the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of a target DNA sequence at or near the genomic locus of one or more endogenous GA3 oxidase and/or GA20 oxidase genes. In another aspect, In yet another aspect, the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of SEQ ID NO: 34, 35, 36, 37, or 38, or a sequence complementary thereto. In an aspect, the guide RNA is a CRISPR RNA (crRNA) or a single-chain guide RNA (sgRNA), or the guide RNA comprises a sequence complementary to a protospacer adjacent motif (PAM) sequence present in the genome of the corn cell immediately adjacent to a target DNA sequence at or near the genomic locus of the one or more endogenous GA3 oxidase and/or GA20 oxidase genes.

Also provided is a method for producing a genome edited or mutated corn plant, the method comprising: (a) introducing into a first corn cell a transgene that encodes one or more CO or COL polypeptides to create a genome edited or mutated corn cell, wherein the first corn cell has its expression of one or more endogenous GA3 oxidase genes or GA20 oxidase genes reduced relative to a wildtype control and comprises a recombinant expression cassette comprising a coding sequence for a MADS-box polypeptide; and (b) generating a genome edited or mutated corn plant from the genome edited or mutated corn cell. In an aspect, the method further comprises identifying a genome edited or mutated corn plant with a desired trait. In another aspect, the identified genome edited or mutated corn plant is semi-dwarf and has one or more improved ear traits, relative to a control corn plant not having the transgene, a reduced expression of one or more endogenous GA3 oxidase genes or GA20 oxidase genes, and the recombinant expression cassette.

Also provided is a method for producing a genome edited or mutated corn plant, the method comprising: (a) introducing into a first corn cell a transgene that encodes one or more MADS-box polypeptides to create a genome edited or mutated corn cell, wherein the first corn cell has its expression of one or more endogenous GA3 oxidase genes or GA20 oxidase genes reduced relative to a wildtype control and comprises a recombinant expression cassette comprising a coding sequence for a CO or COL polypeptide; and (b) generating a genome edited or mutated corn plant from the genome edited or mutated corn cell. In an aspect, the method further comprises identifying a genome edited or mutated corn plant with a desired trait. In another aspect, the identified genome edited or mutated corn plant is semi-dwarf and has one or more improved ear traits, relative to a control corn plant not having the transgene, a reduced expression of one or more endogenous GA3 oxidase genes or GA20 oxidase genes, and the recombinant expression cassette.

In another aspect, the first corn cell of step (a) is obtained by being provided with a first guide RNA and a first RNA-guided nuclease, and wherein the genome edited or mutated corn cell of step (b) is obtained by being provided with a second guide RNA, an insertion sequence, and a second RNA-guided nuclease.

In another aspect, the first guide RNA recognizes a target site in a GA20 oxidase, wherein the first guide RNA acts in association with the first RNA-guided nuclease that creates a double-stranded break at the target site, and whereby the expression of the endogenous GA20 oxidase is reduced.

In another aspect, the method further comprises integrating into the double-stranded break at least one insertion, at least one substitution, at least one inversion, at least one deletion, at least one duplication, or a combination thereof.

In yet another aspect, the second guide RNA recognizes a target site and acts in association with the second RNA-guided nuclease that creates a double-stranded break at the target site, wherein the insertion sequence integrates into the target site, and wherein the donor/insertion sequence encodes a CO or COL polypeptide, such as PpCOL1 polypeptide, or a MADS-box polypeptide, such as maize ZMM19.

Provided in the present disclosure is a method for producing a modified corn plant, the method comprising: mutating or editing one or more endogenous GA3 oxidase genes and/or one or more GA20 oxidase genes in a corn cell, wherein the corn cell comprises a recombinant expression cassette comprising a coding sequence for a CO or COL polypeptide and a recombinant expression cassette comprising a coding sequence for a MADS-box polypeptide, each of the two coding sequences is operably linked to a plant-expressible promoter; and regenerating or developing a modified corn plant from the corn cell, wherein the modified corn plant comprises the two recombinant expression cassette and the one or more mutations and/or edits, and wherein the level of expression or activity of the one or more endogenous GA3 oxidase and/or GA20 oxidase genes in the modified corn plant is reduced relative to a control plant.

In an aspect, the mutating or editing is obtained by using a site-specific nuclease selected from the group consisting of a RNA-guided endonuclease, a meganuclease, a zinc-finger nuclease (ZFN), a TALE-endonuclease (TALEN), a recombinase, and a transposase. In another aspect, a method further comprises introducing a recombinant DNA construct encoding a guide RNA that targets the one or more endogenous GA3 oxidase and/or GA20 oxidase genes. In another aspect, the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of a target DNA sequence at or near the genomic locus of one or more endogenous GA3 oxidase and/or GA20 oxidase genes.

In another aspect, the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of SEQ ID NO: 34, 35, 36, 37, or 38, or a sequence complementary thereto. In another aspect, the guide RNA is a CRISPR RNA (crRNA) or a single-chain guide RNA (sgRNA). In yet another aspect, the guide RNA comprises a sequence complementary to a protospacer adjacent motif (PAM) sequence present in the genome of the corn cell immediately adjacent to a target DNA sequence at or near the genomic locus of the one or more endogenous GA3 oxidase and/or GA20 oxidase genes.

Also provided is a method for producing a genome edited or mutated corn plant, the method comprising: (a) reducing the expression of one or more endogenous GA3 oxidase genes or GA20 oxidase genes in a first corn cell to create a genome edited or mutated corn cell, wherein the first corn cell comprises a transgene that encodes one or more CO or COL polypeptides and a transgene that encodes one or more MADS-box polypeptides; and (b) generating a genome edited or mutated corn plant from the genome edited or mutated corn cell. In an aspect, the method further comprises identifying a genome edited or mutated corn plant with a desired trait. In another aspect, the identified genome edited or mutated corn plant is semi-dwarf and has one or more improved ear traits, relative to a control corn plant not having the two transgenes and a reduced expression of one or more endogenous GA3 oxidase genes or GA20 oxidase genes.

In an aspect, the first corn cell of step (a) is obtained by being provided with a first guide RNA, an insertion sequence, and a first RNA-guided nuclease, and wherein the genome edited or mutated corn cell of step (b) is obtained by being provided with a second guide RNA and a second RNA-guided nuclease.

In another aspect, the first guide RNA recognizes a target site and acts in association with the first RNA-guided nuclease that creates a double-stranded break at the target site, wherein the insertion sequence integrates into the target site, and wherein the insertion sequence encodes a PpCOL1 polypeptide and a maize ZMM19 polypeptide.

In another aspect, the second guide RNA recognizes a target site in a GA20 oxidase, wherein the second guide RNA acts in association with the second RNA-guided nuclease that creates a double-stranded break at the target site, and whereby the expression level of the endogenous GA20 oxidase is reduced.

The gRNA can be transformed or introduced into a plant cell or tissue (perhaps along with a nuclease, or nuclease-encoding DNA molecule, construct or vector) as a gRNA molecule, or as a recombinant DNA molecule, construct or vector comprising a transcribable DNA sequence encoding the guide RNA operably linked to a plant-expressible promoter. The guide sequence of the guide RNA can be at least 10 nucleotides in length, such as 12-40 nucleotides, 12-30 nucleotides, 12-20 nucleotides, 12-35 nucleotides, 12-30 nucleotides, 15-30 nucleotides, 17-30 nucleotides, or 17-25 nucleotides in length, or about 12, 13, 14, 15, 16, 17, 18, 19, 20, 21, 22, 23, 24, 25 or more nucleotides in length. The guide sequence can be at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of a DNA sequence at the genomic target site.

For genome editing at or near the GA20 oxidase_3 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 34 or a sequence complementary thereto (e.g., 12, 13, 14, 15, 16, 17, 18, 19, 20, 21, 22, 23, 24, 25 or more consecutive nucleotides of SEQ ID NO: 34 or a sequence complementary thereto).

For genome editing at or near the GA20 oxidase 4 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 38 or a sequence complementary thereto (e.g., 12, 13, 14, 15, 16, 17, 18, 19, 20, 21, 22, 23, 24, 25 or more consecutive nucleotides of SEQ ID NO: 38 or a sequence complementary thereto).

For genome editing at or near the GA20 oxidase_5 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 35 or a sequence complementary thereto (e.g., 10, 11, 12, 13, 14, 15, 16, 17, 18, 19, 20, 21, 22, 23, 24, 25 or more consecutive nucleotides of SEQ ID NO: 35 or a sequence complementary thereto).

In an aspect, a guide RNA for targeting an endogenous GA20 oxidase_3 and/or GA20 oxidase_5 gene is provided comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, or at least 21 consecutive nucleotides of any one or more of SEQ ID NOs: 138-167.

For genome editing at or near the GA3 oxidase_1 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 36 or a sequence complementary thereto (e.g., 10, 11, 12, 13, 14, 15, 16, 17, 18, 19, 20, 21, 22, 23, 24, 25 or more consecutive nucleotides of SEQ ID NO: 36 or a sequence complementary thereto).

For genome editing at or near the GA3 oxidase 2 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 37 or a sequence complementary thereto (e.g., 10, 11, 12, 13, 14, 15, 16, 17, 18, 19, 20, 21, 22, 23, 24, 25 or more consecutive nucleotides of SEQ ID NO: 37 or a sequence complementary thereto).

In an aspect, a guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of SEQ ID NO: 87, 91, 95, 98, 105, 109, 113, 117, 122, 126, 130 or 137, or a sequence complementary thereto.

In an aspect, a guide RNA comprises a sequence complementary to a protospacer adjacent motif (PAM) sequence present in the genome of a corn plant immediately adjacent to a target DNA sequence at or near the genomic locus of one or more endogenous GA20 or GA3 oxidase gene.

In addition to the guide sequence, a guide RNA can further comprise one or more other structural or scaffold sequence(s), which can bind or interact with an RNA-guided endonuclease. Such scaffold or structural sequences can further interact with other RNA molecules (e.g., tracrRNA). Methods and techniques for designing targeting constructs and guide RNAs for genome editing and site-directed integration at a target site within the genome of a plant using an RNA-guided endonuclease are known in the art.

Mutations such as deletions, insertions, inversions and/or substitutions can be introduced at a target site via imperfect repair of the DSB or nick to produce a knock-out or knock-down of a GA oxidase gene. Such mutations can be generated by imperfect repair of the targeted locus even without the use of a donor template molecule. A "knock-out" of a GA oxidase gene can be achieved by inducing a DSB or nick at or near the endogenous locus of the GA oxidase gene that results in non-expression of the GA oxidase protein or expression of a non-functional protein, whereas a "knock-down" of a GA oxidase gene can be achieved in a similar manner by inducing a DSB or nick at or near the endogenous locus of the GA oxidase gene that is repaired imperfectly at a site that does not affect the coding sequence of the GA oxidase gene in a manner that would eliminate the function of the encoded GA oxidase protein.

For example, the site of the DSB or nick within the endogenous locus can be in the upstream or 5' region of the GA oxidase gene (e.g., a promoter and/or enhancer sequence) to affect or reduce its level of expression. Similarly, such targeted knock-out or knock-down mutations of a GA oxidase gene can be generated with a donor template molecule to direct a particular or desired mutation at or near the target site via repair of the DSB or nick.

The donor template molecule can comprise a homologous sequence with or without an insertion sequence and comprising one or more mutations, such as one or more deletions, insertions, inversions and/or substitutions, relative to the targeted genomic sequence at or near the site of the DSB or nick. For example, targeted knock-out mutations of a GA oxidase gene can be achieved by deleting or inverting at least a portion of the gene or by introducing a frame shift or premature stop codon into the coding sequence of the gene. A deletion of a portion of a GA oxidase gene can also be introduced by generating DSBs or nicks at two target sites and causing a deletion of the intervening target region flanked by the target sites.

Provided herein is a recombinant DNA donor template molecule for site directed to integration of an insertion sequence into the genome of a corn plant comprising an insertion sequence and at least one homology sequence, wherein the homology sequence is at least 70%, at least 75%, at least 80%, at least 85%, at least 90%, at least 95%, at least 96%, at least 97%, at least 99% or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a target DNA sequence in the genome of a corn plant cell, and wherein the insertion sequence comprises an expression cassette comprising a DNA sequence encoding a CO or COL polypeptide, wherein the DNA sequence is operably linked to a plant-expressible promoter.

Provided herein is a recombinant DNA donor template molecule for site directed integration of an insertion sequence into the genome of a corn plant comprising an insertion sequence and at least one homology sequence, wherein the homology sequence is at least 70%, at least 75%, at least 80%, at least 85%, at least 90%, at least 95%, at least 96%, at least 97%, at least 99% or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a target DNA sequence in the genome of a corn plant cell, and wherein the insertion sequence comprises an expression cassette comprising a DNA sequence encoding a MADS-box polypeptide, wherein the DNA sequence is operably linked to a plant-expressible promoter.

In an aspect, the DNA donor template molecule comprises two of the homology sequences, wherein the two homology sequences flank the insertion sequence. In another aspect, the CO or COL polypeptide comprises an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403. In another aspect, the CO or COL polypeptide comprises an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

In another aspect, the CO or COL polypeptide comprises a *Physcomitrella patens* CONSTANS-like 1 (PpCOL1) polypeptide. In another aspect, the DNA sequence comprised in the expression cassette comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169. In another aspect, the CO or COL polypeptide comprises an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168, or a functional fragment thereof. In another aspect, a plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 172 or a functional portion thereof.

In an aspect, the DNA donor template molecule comprises two of the homology sequences, wherein the two homology sequences flank the insertion sequence. In another aspect, the MADS-box polypeptide comprises an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

In another aspect, the MADS-box polypeptide comprises a maize ZMM19 polypeptide. In another aspect, the DNA sequence comprised in the expression cassette comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177. In another aspect, the MADS-box polypeptide comprises an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176, or a functional fragment thereof. In another aspect, a plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 178 or a functional portion thereof.

In another aspect, a DNA donor template molecule further comprises a transcribable DNA sequence encoding a non-coding RNA for suppression of one or more GA20 oxidase genes and/or one or more GA3 oxidase genes, wherein the transcribable DNA sequence is operably linked to a promoter.

In an aspect, a donor template comprising at least one homology sequence or homology arm, wherein the at least one homology sequence or homology arm is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a target DNA sequence, wherein the target DNA sequence is a genomic sequence at or near the genomic locus of an endogenous GA oxidase gene of a corn or cereal plant.

In another aspect, the at least one homology sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of SEQ ID NO: 34, 35, 36, 37, or 38, or a sequence complementary thereto.

In an aspect, a donor template comprising two homology arms including a first homology arm and a second homology arm, wherein the first homology arm comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a first flanking DNA sequence, wherein the second homology arm comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a second flanking DNA sequence, and wherein the first flanking DNA sequence and the second flanking DNA sequence are genomic sequences at or near the genomic locus of an endogenous GA oxidase gene of a corn or cereal plant.

In another aspect, each of the two homology arms is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of SEQ ID NO: 34, 35, 36, 37, or 38, or a sequence complementary thereto.

In another aspect, the method further comprises integrating into the double-stranded break at least one insertion, at least one substitution, at least one inversion, at least one deletion, at least one duplication, or a combination thereof.

In yet another aspect, an insertion sequence of a donor template comprises a sequence encoding a protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 168 and 182-458 and a functional fragment thereof.

In yet another aspect, an insertion sequence of a donor template comprises a sequence encoding a protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 176 and 459-483 and a functional fragment therof.

In an aspect, a target site can comprise at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 29, or at least 30 consecutive nucleotides.

In an aspect, the target site is a GA3 oxidase_1 gene. In another aspect, the target site is a GA3 oxidase_2 gene. In yet another aspect, the target site is a combination of the GA3 oxidase_1 and GA3 oxidase_2 genes. In still another aspect, the target site is within the open reading frame of the GA3 oxidase_1 or GA3 oxidase_2 gene. In still another aspect, the target site is within the promoter/enhancer of the GA3 oxidase_1 or GA3 oxidase_2 gene. In still another aspect, the target site is within the intron of the GA3 oxidase_1 or GA3 oxidase_2 gene. In still another aspect, the target site is within the 5'UTR of the GA3 oxidase 1 or GA3 oxidase_2 gene. In still another aspect, the target site is within the 3'UTR of the GA3 oxidase_1 or GA3 oxidase_2 gene.

In an aspect, the target site is a GA20 oxidase_3 gene. In another aspect, the target site is a GA20 oxidase_4 gene. In another aspect, the target site is a GA20 oxidase_5 gene. In yet another aspect, the target site is a combination of the GA20 oxidase 3 gene, GA20 oxidase 4 gene, and GA20 oxidase_1 gene. In still another aspect, the target site is within the open reading frame of the GA20 oxidase_3, GA20 oxidase_4, or GA20 oxidase_5 gene. In still another aspect, the target site is within the promoter/enhancer of the GA20 oxidase_3, GA20 oxidase_4, or GA20 oxidase_5 gene. In still another aspect, the target site is within the intron of the GA20 oxidase_3, GA20 oxidase_4, or GA20 oxidase_5 gene. In still another aspect, the target site is within the 5'UTR of the GA20 oxidase_3, GA20 oxidase_4, or GA20 oxidase_5 gene. In still another aspect, the target site is within the 3'UTR of the GA20 oxidase_3, GA20 oxidase 4, or GA20 oxidase_5 gene.

In an aspect, the target site comprises a nucleotide sequence selected from the group consisting of SEQ ID NOs: 34, 35, and 38.

A targeted genome editing technique provided herein can comprise the use of one or more, two or more, three or more, four or more, or five or more donor molecules or templates. A "donor template" can be a single-stranded or double-stranded DNA or RNA molecule or plasmid.

According to other aspects, an insertion sequence of a donor template can comprise a transcribable DNA sequence that encodes a non-coding RNA molecule, which targets one or more GA oxidase gene(s), such as a GA3 oxidase or GA20 oxidase gene(s), for suppression. In an aspect, the transcribable DNA sequence that encodes a non-coding RNA for the suppression of the GA3 oxidase and/or GA20 oxidase gene(s) is selected from the group consisting of SEQ ID NOs: 35-38.

In another aspect, an insertion sequence of a donor template can comprise a DNA sequence encoding one or more CO or COL polypeptides, wherein the DNA sequence encodes protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 168 and a functional fragment therof.

In another aspect, an insertion sequence of a donor template can comprise a DNA sequence encoding one or more CO or COL polypeptides, wherein the DNA sequence encodes protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 176-452 and a functional fragment therof.

In another aspect, an insertion sequence of a donor template can comprise a DNA sequence encoding one or more MADS-box polypeptides, wherein the DNA sequence encodes protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 176 and a functional fragment therof.

In another aspect, an insertion sequence of a donor template can comprise a DNA sequence encoding one or more MADS-box polypeptides, wherein the DNA sequence encodes protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 459-483 and a functional fragment therof.

In yet another aspect, an insertion sequence of a donor template can comprise a first transcribable DNA sequence encoding a non-coding RNA molecule for the suppression of the one or more GA3 oxidase or GA20 oxidase gene(s), wherein the first transcribable DNA sequence is selected from the group consisting of SEQ ID NOs: 35-38; an insertion sequence of a donor template can comprise a second DNA sequence encoding one or more CO or COL polypeptides, wherein the second DNA sequence encodes a protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 168, 182-458, and a functional fragment thereof; and an insertion sequence of a donor template can comprise a third DNA sequence encoding one or more MADS-box polypeptides, wherein the third DNA sequence encodes a protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 176, 459-483, and a functional fragment therof.

An insertion sequence provided herein can be of any length. For example, a donor or insertion sequence provided herein is between 2 and 50,000, between 2 and 10,000, between 2 and 5000, between 2 and 1000, between 2 and 500, between 2 and 250, between 2 and 100, between 2 and 50, between 2 and 30, between 15 and 50, between 15 and 100, between 15 and 500, between 15 and 1000, between 15 and 5000, between 18 and 30, between 18 and 26, between 20 and 26, between 20 and 50, between 20 and 100, between 20 and 250, between 20 and 500, between 20 and 1000, between 20 and 5000 or between 20 and 10,000 nucleotides in length.

In an aspect, a sequence can be inserted into a double-stranded break created by a CRISPR based genome editing system without the presence of a donor template. In an aspect, at least one insertion, at least one substitution, at least one deletion, at least one duplication, and/or at least one inversion can be inserted/introduced into a double-stranded break created by a CRISPR based genome editing system via non-homologous end joining (NHEJ) without a donor template. In an aspect, at least one insertion, at least one substitution, at least one deletion, at least one duplication, and/or at least one inversion can be inserted/introduced into a double-stranded break created by a CRISPR based genome editing system via homologous recombination (HR) with a donor template.

According to other aspects, at least one insertion is integrated into the double-stranded break at the GA3 oxidase or GA20 oxidase locus and introduces a premature stop codon therein which leads to truncation of the GA3 oxidase or GA20 oxidase proteins and subsequent suppression of the GA3 oxidase or GA20 oxidase genes. In an aspect, the at least one insertion is a single nucleobase insertion. In another aspect, the single nucleobase insertion is selected from the group consisting of guanine, cytosine, adenine, thymine, and uracil. In an aspect, the at least one insertion is inserted within the open reading frame of the GA3 oxidase or GA20 oxidase gene. In another aspect, the at least one insertion is inserted within the promoter/enhancer, intron, 5'UTR, 3'UTR, or a combination therof.

In another aspect, the at least one insertion at the GA3 oxidase or GA20 oxidase locus comprises at least 2 nucleotides, at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, or at least 20 nucleotides.

According to an aspect, at least one substitution is integrated into the double-stranded break at the GA3 oxidase or GA20 oxidase locus that leads to the suppression of the GA3 oxidase or GA20 oxidase gene. In an aspect, the at least one substitution is integrated within the open reading frame of the GA3 oxidase or GA20 oxidase gene. In another aspect, the at least one substitution is integrated within the promoter/enhancer, intron, 5'UTR, 3'UTR, or a combination therof.

According to an aspect, at least one deletion is introduced into the double-stranded break at the GA3 oxidase or GA20 oxidase locus that leads to the suppression of the GA3 oxidase or GA20 oxidase gene. In an aspect, the at least one deletion is introduced within the open reading frame of the GA3 oxidase or GA20 oxidase gene. In another aspect, the at least one deletion is introduced within the promoter/enhancer, intron, 5'UTR, 3'UTR, or a combination therof.

According to an aspect, at least one duplication is introduced into the double-stranded break at the GA3 oxidase or GA20 oxidase locus that leads to the suppression of the GA3 oxidase or GA20 oxidase gene. In an aspect, the at least one duplication is introduced within the open reading frame of the GA3 oxidase or GA20 oxidase gene. In another aspect, the at least one duplication is introduced within the promoter/enhancer, intron, 5'UTR, 3'UTR, or a combination therof.

According to an aspect, at least one inversion is integrated into the double-stranded break at the GA3 oxidase or GA20 oxidase locus that leads to the suppression of the GA3 oxidase or GA20 oxidase gene. In an aspect, the at least one inversion is integrated within the open reading frame of the GA3 oxidase or GA20 oxidase gene. In another aspect, the at least one inversion is integrated within the promoter/enhancer, intron, 5'UTR, 3'UTR, or a combination therof.

According to an aspect, a recombinant DNA construct or vector can comprise a first polynucleotide sequence encoding a site-specific nuclease and a second polynucleotide sequence encoding a guide RNA that can be introduced into a plant cell together via plant transformation techniques. Alternatively, two recombinant DNA constructs or vectors can be provided including a first recombinant DNA construct or vector and a second DNA construct or vector that can be introduced into a plant cell together or sequentially via plant transformation techniques, where the first recombinant DNA construct or vector comprises a polynucleotide sequence encoding a site-specific nuclease and the second recombinant DNA construct or vector comprises a polynucleotide sequence encoding a guide RNA.

According to an aspect, a recombinant DNA construct or vector comprising a polynucleotide sequence encoding a site-specific nuclease can be introduced via plant transformation techniques into a plant cell that already comprises (or is transformed with) a recombinant DNA construct or vector comprising a polynucleotide sequence encoding a guide RNA. Alternatively, a recombinant DNA construct or vector comprising a polynucleotide sequence encoding a guide RNA can be introduced via plant transformation techniques into a plant cell that already comprises (or is transformed with) a recombinant DNA construct or vector comprising a polynucleotide sequence encoding a site-specific nuclease. According to yet further aspects, a first plant comprising (or transformed with) a recombinant DNA construct or vector comprising a polynucleotide sequence encoding a site-specific nuclease can be crossed with a second plant comprising (or transformed with) a recombinant DNA construct or vector comprising a polynucleotide sequence encoding a guide RNA. Such recombinant DNA constructs or vectors can be transiently transformed into a plant cell or stably transformed or integrated into the genome of a plant cell.

In an aspect, vectors comprising polynucleotides encoding a site-specific nuclease, and optionally one or more, two or more, three or more, or four or more gRNAs are provided to a plant cell by transformation methods known in the art (e.g., without being limiting, particle bombardment, PEG-mediated protoplast transfection or *Agrobacterium*-mediated transformation). In an aspect, vectors comprising polynucleotides encoding a Cas9 nuclease, and optionally one or more, two or more, three or more, or four or more gRNAs are provided to a plant cell by transformation methods known in the art (e.g., without being limiting, particle bombardment, PEG-mediated protoplast transfection or *Agrobacterium*-mediated transformation). In another aspect, vectors comprising polynucleotides encoding a Cpf1 and, optionally one or more, two or more, three or more, or four or more crRNAs are provided to a cell by transformation methods known in the art (e.g., without being limiting, viral transfection, particle bombardment, PEG-mediated protoplast transfection or *Agrobacterium*-mediated transformation).

Dwarf or semi-dwarf corn disclosed herein can have characteristics that make it suitable for grain and forage production, especially, production in short-season environments. In particular, limited heat units in short-season environments reduce grain yield and lessen the probability of the crop reaching physiological maturity in a given year. The disclosed dwarf or semi-dwarf corn plants require fewer heat units (e.g., required 10%) than conventional hybrids to reach anthesis and generally reach physiological maturity earlier than conventional cultivars. Semi-dwarf corn plants disclosed herein are less prone to stalk and root lodging due to the shorter stalks and lower ear placement. Corn plants disclosed herein also have the potential to produce high-quality forage due to its high ear-to-stover ratio.

Short stature or semi-dwarf corn plants can also have one or more additional traits, including, but not limited to, increased stem diameter, reduced green snap, deeper roots, increased leaf area, earlier canopy closure, higher stomatal conductance, lower ear height, increased foliar water content, improved drought tolerance, increased nitrogen use efficiency, increased water use efficiency, reduced anthocyanin content and area in leaves under normal or nitrogen or water limiting stress conditions, increased ear weight, increased kernel number, increased kernel weight, increased yield, increased seed number, increased seed weight, and increased prolificacy, and/or increased harvest index.

According to aspects of the present disclosure, modified, transgenic, or genome edited/mutated cereal or corn plants are provided that have at least one beneficial agronomic trait and at least one female reproductive organ or ear that is substantially or completely free of off-types. The beneficial agronomic trait can include, but is not limited to, shorter plant height, shorter internode length in one or more internode(s), larger (thicker) stem or stalk diameter, increased lodging resistance, improved drought tolerance, increased nitrogen use efficiency, increased water use efficiency, deeper roots, larger leaf area, earlier canopy closure, and/or increased harvestable yield. As used herein, "harvest index" refers to the mass of the harvested grain divided by the total mass of the above-ground biomass of the plant over a harvested area.

In an aspect, a modified, transgenic, or genome edited/mutated corn plant exhibits improved lodging resistance, reduced green snap, or both, relative to a control corn plant.

In an aspect, the height at maturity of a modified, transgenic, or genome edited/mutated corn plant exhibiting semi-dwarf phenotype is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, at least 70%, or at least 75%, relative to a control corn plant grown under comparable conditions.

According to another aspect of the present disclosure, a modified, transgenic, or genome edited/mutated corn plant provided herein comprises a height that is between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 15%, between 1% and 10%, between 1% and 5%, or between 1% and 2%, of that of a control plant grown under comparable conditions.

According to another aspect of the present disclosure, a modified, transgenic, or genome edited/mutated corn plant provided herein comprises a height that is between 2% and 75%, between 5% and 75%, between 10% and 75%, between 15% and 75%, between 20% and 75%, between 25% and 75%, between 30% and 75%, between 35% and 75%, between 40% and 75%, between 45% and 75%, between 50% and 75%, between 55% and 75%, between 60% and 75%, between 65% and 75%, or between 70% and 75%, of that of a control plant grown under comparable conditions.

According to another aspect of the present disclosure, a modified, transgenic, or genome edited/mutated corn plant provided herein comprises a height that is between 2% and 70%, between 5% and 65%, between 10% and 60%, between 15% and 55%, between 20% and 50%, between 25% and 45%, or between 30% and 40%, of that of a control plant grown under comparable conditions.

According to another aspect of the present disclosure, a modified, transgenic, or genome edited/mutated corn plant provided herein comprises a height that is between 1% and 10%, between 10% and 20%, between 20% and 30%, between 30% and 40%, between 40% and 50%, between 50% and 60%, between 60% and 70%, or between 70% and 80%, of that of a control plant grown under comparable conditions.

In an aspect, the stalk or stem diameter of a transgenic corn plant or genome edited/mutated corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plan grown under comparable conditions.

According to another aspect of the present disclosure, a modified, transgenic, or genome edited/mutated corn plant provided herein comprises a stalk or stem diameter that is between 0.1% and 100%, between 0.2% and 100%, between 0.5% and 100%, between 1% and 100%, between 1.5% and 100%, between 2% and 100%, between 2.5% and 100%, between 3% and 100%, between 3.5% and 100%, between 4% and 100%, between 4.5% and 100%, between 5% and 100%, between 6% and 100%, between 7% and 100%, between 8% and 100%, between 9% and 100%, between 10% and 100%, between 15% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100%, greater than that of a control corn plan grown under comparable conditions.

According to another aspect of the present disclosure, a modified, transgenic, or genome edited/mutated corn plant provided herein comprises a stalk or stem diameter that is between 0.1% and 95%, between 0.1% and 90%, between 0.1% and 85%, between 0.1% and 80%, between 0.1% and 75%, between 0.1% and 70%, between 0.1% and 65%, between 0.1% and 60%, between 0.1% and 55%, between 0.1% and 50%, between 0.1% and 45%, between 0.1% and 40%, between 0.1% and 35%, between 0.1% and 30%, between 0.1% and 25%, between 0.1% and 20%, between 0.1% and 15%, between 0.1% and 10%, between 0.1% and 9%, between 0.1% and 8%, between 0.1% and 7%, between 0.1% and 6%, between 0.1% and 5%, between 0.1% and 4.5%, between 0.1% and 4%, between 0.1% and 3.5%, between 0.1% and 3%, between 0.1% and 2.5%, between 0.1% and 2%, between 0.1% and 1.5%, between 0.1% and 1%, between 0.1% and 0.5%, or between 0.1% and 0.2%, greater than that that of a control corn plan grown under comparable conditions.

According to another aspect of the present disclosure, a modified, transgenic, or genome edited/mutated corn plant provided herein comprises a stalk or stem diameter that is between 0.2% and 95%, between 0.5% and 90%, between 1% and 85%, between 1.5% and 80%, between 2% and 75%, between 2.5% and 70%, between 3% and 65%, between 3.5% and 60%, between 4% and 55%, between 4.5% and 50%, between 5% and 45%, between 6% and 40%, between 7% and 35%, between 8% and 30%, between 9% and 25%, or between 10% and 20%, greater than that that of a control corn plan grown under comparable conditions.

According to another aspect of the present disclosure, a modified, transgenic, or genome edited/mutated corn plant provided herein comprises a stalk or stem diameter that is between 0.1% and 1%, between 1% and 5%, between 6% and 10%, between 20% and 30%, between 30% and 40%, between 40% and 50%, between 50% and 60%, between 60% and 70%, between 70% and 80%, between 80% and 90%, between 90% and 100%, greater than that that of a control corn plan grown under comparable conditions.

In another aspect, the yield of a modified, transgenic, or genome edited/mutated exhibiting semi-dwarf phenotype is equal to or more then the yield of a control plant grown under comparable conditions.

In another aspect, a modified, transgenic, or genome edited/mutated corn plant exhibiting semi-dwarf phenotype requires about 5%, 10%, 15%, 20%, or 25% fewer heat units than a control plant to reach anthesis.

In yet another aspect, a modified, transgenic, or genome edited/mutated corn plant exhibiting semi-dwarf phenotype has a relative maturity of about 10%, 15%, 20%, 25%, 30%, 35%, 40%, or 45% fewer days than the relative maturity of a control plant grown under comparable conditions.

According to an aspect of the present disclosure, a modified, transgenic, or genome edited/mutated corn plant provided herein comprises a height of less than 2000 mm, less than 1950 mm, less than 1900 mm, less than 1850 mm, less than 1800 mm, less than 1750 mm, less than 1700 mm, less than 1650 mm, less than 1600 mm, less than 1550 mm, less than 1500 mm, less than 1450 mm, less than 1400 mm, less than 1350 mm, less than 1300 mm, less than 1250 mm, less than 1200 mm, less than 1150 mm, less than 1100 mm, less than 1050 mm, or less than 1000 mm and an average stem diameter of at least 17.5 mm, at least 18 mm, at least 18.5 mm, at least 19 mm, at least 19.5 mm, at least 20 mm, at least 20.5 mm, at least 21 mm, at least 21.5 mm, or at least 22 mm. According to another aspect the modified corn plant further comprises at least one ear that is substantially free of mature male reproductive tissue.

According to aspects of the present disclosure, modified, transgenic, or genome edited/mutated corn plants are provided that comprise a plant height during late vegetative and/or reproductive stages of development (e.g., at R3 stage) of between 1000 mm and 1800 mm, between 1000 mm and 1700 mm, between 1050 mm and 1700 mm, between 1100 mm and 1700 mm, between 1150 mm and 1700 mm, between 1200 mm and 1700 mm, between 1250 mm and 1700 mm, between 1300 mm and 1700 mm, between 1350 mm and 1700 mm, between 1400 mm and 1700 mm, between 1450 mm and 1700 mm, between 1000 mm and 1500 mm, between 1050 mm and 1500 mm, between 1100 mm and 1500 mm, between 1150 mm and 1500 mm, between 1200 mm and 1500 mm, between 1250 mm and 1500 mm, between 1300 mm and 1500 mm, between 1350 mm and 1500 mm, between 1400 mm and 1500 mm, between 1450 mm and 1500 mm, between 1000 mm and 1600 mm, between 1100 mm and 1600 mm, between 1200 mm and 1600 mm, between 1300 mm and 1600 mm, between 1350 mm and 1600 mm, between 1400 mm and 1600 mm, between 1450 mm and 1600 mm, of between 1000 mm and 2000 mm, between 1200 mm and 2000 mm, between 1200 mm and 1800 mm, between 1300 mm and 1700 mm, between 1400 mm and 1700 mm, between 1400 mm and 1600 mm, between 1400 mm and 1700 mm, between 1400 mm and 1800 mm, between 1400 mm and 1900 mm, between 1400 mm and 2000 mm, or between 1200 mm and 2500 mm, and/or an average stem diameter of between 17.5 mm and 22 mm, between 18 mm and 22 mm, between 18.5 and 22 mm, between 19 mm and 22 mm, between 19.5 mm and 22 mm, between 20 mm and 22 mm, between 20.5 mm and 22 mm, between 21 mm and 22 mm, between 21.5 mm and 22 mm, between 17.5 mm and 21 mm, between 17.5 mm and 20 mm, between 17.5 mm and 19 mm, between 17.5 mm and 18 mm, between 18 mm and 21 mm, between 18 mm and 20 mm, or between 18 mm and 19 mm. A modified corn plant can be substantially free of off-types, such as male reproductive tissues or structures in one or more ears of the modified corn plant.

According to an aspect of the present disclosure a modified, transgenic, or genome edited/mutated corn plant provided herein comprises a height of between 1000 mm and 1600 mm, 1000 mm and 1500 mm, between 1050 mm and 1500 mm, between 1100 mm and 1500 mm, between 1150 mm and 1500 mm, between 1200 mm and 1500 mm, between 1250 mm and 1500 mm, between 1300 mm and 1500 mm, between 1350 mm and 1500 mm, between 1400 mm and 1500 mm, between 1450 mm and 1500 mm, between 1000 mm and 1600 mm, between 1100 mm and 1600 mm, between 1200 mm and 1600 mm, between 1300 mm and 1600 mm, or between 1000 mm and 1300 mm, and an average stem diameter of between 17.5 mm and 22 mm, between 18 mm and 22 mm, between 18.5 and 22 mm, between 19 mm and 22 mm, between 19.5 mm and 22 mm, between 20 mm and 22 mm, between 20.5 mm and 22 mm, between 21 mm and 22 mm, between 21.5 mm and 22 mm, between 17.5 mm and 21 mm, between 17.5 mm and 20 mm, between 17.5 mm and 19 mm, between 17.5 mm and 18 mm, between 18 mm and 21 mm, between 18 mm and 20 mm, or between 18 mm and 19 mm. According to another aspect the modified corn plant further comprises at least one ear that is substantially free of mature male reproductive tissue.

According to an aspect of the present disclosure, a modified, transgenic, or genome edited/mutated corn plant provided herein comprises a height that is at least 5%, at least 10%, at least 15%, at least 20%, at least 25%, at least 30%, at least 35%, at least 40%, at least 45%, at least 50%, at least 55%, at least 60%, at least 65%, at least 70%, or at least 75% less than the height of a control plant and a stalk or stem diameter that is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% greater than the stem diameter of a control plant.

According to an aspect of the present disclosure, a modified, transgenic, or genome edited/mutated corn plant provided herein comprises a fresh ear weight that is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% greater than the fresh ear weight of a control plant.

According to an aspect of the present disclosure, a population of modified, transgenic, or genome edited/mutated corn plants provided herein comprises a lodging frequency that is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or 100% lower as compared to a population of unmodified control plants. According to another aspect of the present disclosure, a population of modified corn plants provided herein comprises a lodging frequency that is between 5% and 100%, between 5% and 95%, between 5% and 90%, between 5% and 85%, between 5% and 80%, between 5% and 75%, between 5% and 70%, between 5% and 65%, between 5% and 60%, between 5% and 55%, between 5% and 50%, between 5% and 45%, between 5% and 40%, between 5% and 35%, between 5% and 30%, between 5% and 25%, between 5% and 20%, between 5% and 15%, between 5% and 10%, between 10% and 100%, between 10% and 75%, between 10% and 50%, between 25% and 75%, between 25% and 50%, or between 50% and 75% lower as compared to a population of control plants.

According to an aspect of the present disclosure, modified, transgenic, or genome edited/mutated corn plants are provided that comprise an average internode length (or a minus-2 internode length and/or minus-4 internode length relative to the position of the ear) that is at least 5%, at least 10%, at least 15%, at least 20%, at least 25%, at least 30%, at least 35%, at least 40%, at least 45%, at least 50%, at least 55%, at least 60%, at least 65%, at least 70%, or at least 75% less than the same or average internode length of a control plant.

The "minus-2 internode" of a corn plant refers to the second internode below the ear of the plant, and the "minus-4 internode" of a corn plant refers to the fourth internode below the ear of the plant. According to many aspects, modified, transgenic, or genome edited/mutated corn plants are provided that have an average internode length (or a minus-2 internode length and/or minus-4 internode length relative to the position of the ear) that is between 5% and 75%, between 5% and 50%, between 10% and 70%, between 10% and 65%, between 10% and 60%, between 10% and 55%, between 10% and 50%, between 10% and 45%, between 10% and 40%, between 10% and 35%, between 10% and 30%, between 10% and 25%, between 10% and 20%, between 10% and 15%, between 10% and 10%, between 10% and 75%, between 25% and 75%, between 10% and 50%, between 20% and 50%, between 25% and 50%, between 30% and 75%, between 30% and 50%, between 25% and 50%, between 15% and 50%, between 20% and 50%, between 25% and 45%, or between 30% and 45% less than the same or average internode length of a control plant.

A modified, transgenic, or genome edited/mutated corn plant can have a harvest index that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 20%, at least 25%, at least 30%, at least 35%, at least 40%, at least 45%, or at least 50% greater than the harvest index of a wild-type or control plant. A modified corn plant can have a harvest index that is between 1% and 45%, between 1% and 40%, between 1% and 35%, between 1% and 30%, between 1% and 25%, between 1% and 20%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, between 1% and 2%, between 5% and 15%, between 5% and 20%, between 5% and 30%, or between 5% and 40% greater than the harvest index of a control plant.

According to an aspect of the present disclosure, modified, transgenic, or genome edited/mutated corn plants are provided that have an increase in harvestable yield of at least 1 bushel per acre, at least 2 bushels per acre, at least 3 bushels per acre, at least 4 bushels per acre, at least 5 bushels per acre, at least 6 bushels per acre, at least 7 bushels per acre, at least 8 bushels per acre, at least 9 bushels per acre, or at least 10 bushels per acre, relative to a wild-type or control plant. A modified corn plant can have an increase in harvestable yield between 1 and 10, between 1 and 8, between 2 and 8, between 2 and 6, between 2 and 5, between 2.5 and 4.5, or between 3 and 4 bushels per acre. A modified corn plant can have an increase in harvestable yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 20%, or at least 25% greater than the harvestable yield of a wild-type or control plant. A modified corn plant can have a harvestable yield that is between 1% and 25%, between 1% and 20%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, between 1% and 2%, between 5% and 15%, between 5% and 20%, between 5% and 25%, between 2% and 10%, between 2% and 9%, between 2% and 8%, between 2% and 7%, between 2% and 6%, between 2% and 5%, or between 2% and 4% greater than the harvestable yield of a control plant.

According to an aspect, the present disclosure provides a population of a modified, transgenic, or genome edited/mutated corn plants, where the population of a modified, transgenic, or genome edited/mutated corn plants shares ancestry with a single a modified, transgenic, or genome edited/mutated corn plant, where the population of a modified, transgenic, or genome edited/mutated corn plants comprises an average height of 1500 mm or less, wherein the population of a modified, transgenic, or genome edited/ mutated corn plants comprises an average stalk or stem diameter of 18 mm or more, wherein less than 5%, less than 10%, less than 15%, less than 20%, or less than 25% of the population of modified, transgenic, or genome edited/mutated corn plants comprises a height of greater than 1500 mm, and where less than 5%, less than 10%, less than 15%, less than 20%, or less than 25% of the population of a modified, transgenic, or genome edited/mutated corn plants comprises at least one ear comprising mature male reproductive tissue. In another aspect the population of a modified, transgenic, or genome edited/mutated corn plants comprises an average height of 1200 mm or less.

According to an aspect, the present disclosure provides a population of a modified, transgenic, or genome edited/ mutated corn plants, where the population of a modified, transgenic, or genome edited/mutated corn plants share ancestry with a single modified corn plant, where the population of a modified, transgenic, or genome edited/mutated corn plants comprises an average height of 1500 mm or less, where less than 5%, less than 10%, less than 15%, less than 20%, or less than 25% of the population of modified corn plants comprises a height of greater than 1500 mm, and where the population of a modified, transgenic, or genome edited/mutated corn plants comprises a lodging frequency that is at least 5%, at least 10%, at least 20%, at least 30%, at least 40%, at least 50%, at least 60%, at least 70% at least 80%, at least 90%, or 100% lower as compared to a population of control corn plants.

According to an aspect, the present disclosure provides a modified, transgenic, or genome edited/mutated corn plant comprising a height of 1500 mm or less, where the a modified, transgenic, or genome edited/mutated corn plant further comprises a stalk or stem diameter of 18 mm or more, and where at least one ear of the a modified, transgenic, or genome edited/mutated corn plant is substantially free of mature male reproductive tissue.

According to an aspect, the present disclosure provides a modified, transgenic, or genome edited/mutated corn plant comprising a height of 1500 mm or less, wherein the a modified, transgenic, or genome edited/mutated corn plant further comprises a harvest index of at least 0.58, and where the a modified, transgenic, or genome edited/mutated corn plant further comprises at least one ear that is substantially free of mature male reproductive tissue.

According to an aspect of the present disclosure, modified, transgenic, or genome edited/mutated corn plants are provided having a significantly reduced or eliminated expression level of one or more GA3 oxidase and/or GA20 oxidase gene transcript(s) and/or protein(s) in one or more tissue(s), such as one or more stem, internode, leaf and/or vascular tissue(s), of the modified, transgenic, or genome edited/mutated plants, as compared to the same tissue(s) of wild-type or control plants. In an aspect, the level of one or more GA3 oxidase and/or GA20 oxidase gene transcript(s) and/or protein(s), or one or more GA oxidase (or GA oxidase-like) gene transcript(s) and/or protein(s), in one or more stem, internode, leaf and/or vascular tissue(s) of a modified corn plant can be at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% less or lower than in the same tissue(s) of a control corn or cereal plant.

According to an aspect of the present disclosure, modified, transgenic, or genome edited/mutated cereal or corn plants are provided that have at least one beneficial agronomic trait and at least one female reproductive organ or ear that is substantially or completely free of off-types. The beneficial agronomic trait can include, for example, shorter plant height, shorter internode length in one or more internode(s), larger (thicker) stem or stalk diameter, increased lodging resistance, improved drought tolerance, increased nitrogen use efficiency, increased water use efficiency, deeper roots, larger leaf area, earlier canopy closure, and/or increased harvestable yield. A modified, transgenic, or genome edited/mutated cereal or corn plant can have a female reproductive organ or ear that appears normal relative to a control or wild-type plant. Indeed, modified, transgenic, or genome edited/mutated cereal or corn plants are provided that comprise at least one reproductive organ or ear that does not have or exhibit, or is substantially or completely free of, off-types including male sterility, reduced kernel or seed number, and/or masculinized structure(s) in one or more female organs or ears.

A modified, transgenic, or genome edited/mutated cereal or corn plant is provided herein that lacks significant off-types in the reproductive tissues of the plant. Off-types can include male (tassel or anther) sterility, reduced kernel or seed number, and/or the presence of one or more masculinized or male (or male-like) reproductive structures in the female organ or ear (e.g., anther ear) of the plant.

As used herein, a female organ or ear of a plant, such as corn, is "substantially free" of male reproductive structures if male reproductive structures are absent or nearly absent in the female organ or ear of the plant based on visual inspection of the female organ or ear at later reproductive stages. A female organ or ear of a plant, such as corn, is "completely free" of mature male reproductive structures if male reproductive structures are absent or not observed or observable in the female organ or ear of the plant, such as a corn plant, by visual inspection of the female organ or ear at later reproductive stages.

In an aspect, a modified, transgenic, or genome edited/mutated corn plant exhibits increased ear area relative to a control corn plant.

According to an aspect of the present disclosure, a modified, transgenic, or genome edited/mutated corn plant exhibits an increase in ear area by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits an ear area that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits an ear area that is between 1% and 95%, between 1% and 90%, between 1% and 85%, between 1% and 80%, between 90% and 75%, between 1% and 70%, between to 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits an ear area that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits an ear area that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

In an aspect, a modified, transgenic, or genome edited/mutated corn plant exhibits increased ear volume relative to a control corn plant grown under comparable conditions.

According to an aspect of the present disclosure, a modified, transgenic, or genome edited/mutated corn plant exhibits an increase in ear volume by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits an ear volume that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits an ear volume that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits an ear volume that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits an ear volume that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

In an aspect, a modified, transgenic, or genome edited/mutated corn plant exhibits increased ear diameter relative to a control corn plant grown under comparable conditions.

According to an aspect of the present disclosure, a modified, transgenic, or genome edited/mutated corn plant exhibits an ear diameter that is at least 0.2%, at least 0.4%, at least 0.6%, at least 0.8%, at least 1.0%, at least 1.2%, at least 1.4%, at least 1.6%, at least 1.8%, at least 2.0%, at least 2.2%, at least 2.4%, at least 2.6%, at least 2.8%, at least 3.0%, at least 3.2%, at least 3.4%, at least 3.6%, at least 3.8%, at least 4.0%, at least 4.5%, at least 5.0%, at least 5.5%, at least 6.0%, at least 6.5%, at least 7.0%, at least 7.5%, at least 8.0%, at least 8.5%, at least 9.0%, at least 9.5%, at least 10.0%, relative to a control corn plant.

According to an aspect of the present disclosure, a modified, transgenic, or genome edited/mutated corn plant exhibits an ear diameter that is between 0.2% and 10.0%, between 0.4% and 10.0%, between 0.6% and 10.0%, between 0.8% and 10.0%, between 1.0% and 10.0%, between 1.2% and 10.0%, between 1.4% and 10.0%, between 1.6% and 10.0%, between 1.8% and 10.0%, between 2.0% and 10.0%, between 2.2% and 10.0%, between 2.4% and 10.0%, between 2.6% and 10.0%, between 2.8% and 10.0%, between 3.0% and 10.0%, between 3.2% and 10.0%, between 3.4% and 10.0%, between 3.6% and 10.0%, between 3.8% and 10.0%, between 4.0% and 10.0%, between 4.5% and 10.0%, between 5.0% and 10.0%, between 5.5% and 10.0%, between 6.0% and 10.0%, between 6.5% and 10.0%, between 7.0% and 10.0%, between 7.5% and 10.0%, between 8.0% and 10.0%, between 8.5% and 10.0%, between 9.0% and 10.0%, or between 9.5% and 10.0%, greater than that of a control corn plant grown under comparable conditions.

According to an aspect of the present disclosure, a modified, transgenic, or genome edited/mutated corn plant exhibits an ear diameter that is between 0.2% and 9.5%, between 0.2% and 9.0%, between 0.2% and 8.5%, between 0.2% and 8.0%, between 0.2% and 7.5%, between 0.2% and 7.0%, between 0.2% and 6.5%, between 0.2% and 6.0%, between 0.2% and 5.5%, between 0.2% and 5.0%, between 0.2% and 4.5%, between 0.2% and 4.0%, between 0.2% and 3.8%, between 0.2% and 3.6%, between 0.2% and 3.4%, between 0.2% and 3.2%, between 0.2% and 3.0%, between 0.2% and 2.8%, between 0.2% and 2.6%, between 0.2% and 2.4%, between 0.2% and 2.2%, between 0.2% and 2.0%, between 0.2% and 1.8%, between 0.2% and 1.6%, between 0.2% and 1.4%, between 0.2% and 1.2%, between 0.2% and 1.0%, between 0.2% and 0.8%, between 0.2% and 0.6%, or between 0.2% and 0.4%, greater than that of a control corn plant grown under comparable conditions.

According to an aspect of the present disclosure, a modified, transgenic, or genome edited/mutated corn plant exhibits an ear diameter that is between 0.4% and 9.5%, between 0.6% and 9.0%, between 0.8% and 8.5%, between 1.0% and 8.0%, between 1.2% and 7.5%, between 1.4% and 7.0%, between 1.6% and 6.5%, between 1.8% and 6.0%, between 2.0% and 5.5%, between 2.2% and 5.0%, between 2.4% and 4.5%, between 2.6% and 4.0%, between 2.8% and 3.8%, between 3.0% and 3.6%, or between 3.2% and 3.4%, greater than that of a control corn plant grown under comparable conditions.

According to an aspect of the present disclosure, a modified, transgenic, or genome edited/mutated corn plant exhibits an ear diameter that is between 0.2% and 0.6%, between 0.6% and 1.0%, between 1.0% and 1.4%, between 1.4% and 1.8%, between 1.8% and 2.2%, between 2.2% and 2.6%, between 2.6% and 3.0%, between 3.0% and 3.5%, between 3.5% and 4.0%, between 4.0% and 4.5%, between 4.5% and 5.0%, between 5.0% and 5.5%, between 5.5% and 6.0%, between 6.0% and 6.5%, between 6.5% and 7.0%, between 7.0% and 7.5%, between 7.5% and 8.0%, between 8.0% and 8.5%, between 8.5% and 9.0%, between 9.0% and 9.5%, or between 9.5% and 10.0%, greater than that of a control corn plant grown under comparable conditions.

In an aspect, a modified, transgenic, or genome edited/mutated corn plant exhibits increased ear length relative to a control corn plant grown under comparable conditions.

According to an aspect of the present disclosure, a modified, transgenic, or genome edited/mutated corn plant exhibits an increase in ear length by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits an ear length that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% to and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a corn plant grown under comparable conditions.

According to an aspect of the present disclosure, a modified, transgenic, or genome edited/mutated corn plant exhibits an ear length that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits an ear length that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits an ear length that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

In an aspect, a modified, transgenic, or genome edited/mutated corn plant exhibits decreased ear tip void relative to a control corn plant grown under comparable conditions.

According to an aspect of the present disclosure, a modified, transgenic, or genome edited/mutated corn plant exhibits an decrease in ear tip void by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits an ear tip void that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% less than that of a control corn plant grown under comparable conditions.

According to an aspect of the present disclosure, a modified, transgenic, or genome edited/mutated corn plant exhibits an ear tip void that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% less than that of a control corn plant grown under comparable conditions.

According to an aspect of the present disclosure, a modified, transgenic, or genome edited/mutated corn plant exhibits an ear tip void that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% less than that of a control corn plant grown under comparable conditions.

According to an aspect of the present disclosure, a modified, transgenic, or genome edited/mutated corn plant exhibits an ear tip void that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% less than that of a control corn plant grown under comparable conditions.

In an aspect, a modified, transgenic, or genome edited/mutated corn plant exhibits decreased ear void relative to a control corn plant grown under comparable conditions.

According to an aspect of the present disclosure, a modified, transgenic, or genome edited/mutated corn plant exhibits an decrease in ear void by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits an ear void that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% less than that of a control corn plant grown under comparable conditions.

According to an aspect of the present disclosure, a modified, transgenic, or genome edited/mutated corn plant exhibits an ear void that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% less than that of a control corn plant grown under comparable conditions.

According to an aspect of the present disclosure, a modified, transgenic, or genome edited/mutated corn plant exhibits an ear void that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% less than that of a control corn plant grown under comparable conditions.

According to an aspect of the present disclosure, a modified, transgenic, or genome edited/mutated corn plant exhibits an ear void that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% less than that of a control corn plant grown under comparable conditions.

In an aspect, a modified, transgenic, or genome edited/mutated corn plant exhibits an increased number of kernels per ear relative to a control corn plant grown under comparable conditions.

According to an aspect of the present disclosure, a modified, transgenic, or genome edited/mutated corn plant exhibits an increase in number of kernels per ear by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits kernels per ear that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits kernels per ear that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits kernels per ear that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits kernels per ear that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

In an aspect, a modified, transgenic, or genome edited/mutated corn plant exhibits increased single kernel weight relative to a control corn plant grown under comparable conditions.

According to an aspect of the present disclosure, a modified, transgenic, or genome edited/mutated corn plant exhibits an increase in single kernel weight by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits a single kernel weight that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits a single kernel weight that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits a single kernel weight that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits a single kernel weight that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

According to an aspect of the present disclosure, a modified, transgenic, or genome edited/mutated corn plant exhibits a single kernel weight that is between 1% and 2%, between 2% and 3%, between 3% and 4%, between 4% and 5%, between 5% and 6%, between 6% and 7%, between 7% and 8%, between 8% and 9%, or between 9% and 10% greater than that of a control corn plant grown under comparable conditions.

In an aspect, a modified, transgenic, or genome edited/mutated corn plant exhibits increased ear fresh weight relative to a control corn plant.

According to an aspect of the present disclosure, a modified, transgenic, or genome edited/mutated corn plant exhibits an increased ear fresh weight by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% relative to a control corn plant grown under comparable conditions.

According to an aspect of the present disclosure, a modified, transgenic, or genome edited/mutated corn plant exhibits an ear fresh weight that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 21% and 100%, between 22% and 100%, between 23% and 100%, between 24% and 100%, between 25% and 100%, between 26% and 100%, between 27% and 100%, between 28% and 100%, between 29% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits an ear fresh weight that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 29%, between 1% and 28%, between 1% and 27%, between 1% and 26%, between 1% and 25%, between 1% and 24%, between 1% and 23%, between 1% and 22%, between 1% and 21%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits an ear fresh weight that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits an ear fresh weight that is between 1% and 5%, between 5% and 10%, between 10% and 15%, between 15% and 20%, between 20% and 25%, between 25% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

According to an aspect of the present disclosure, a modified, transgenic, or genome edited/mutated corn plant exhibits an ear fresh weight that is between 1% and 2%, between 2% and 3%, between 3% and 4%, between 4% and 5%, between 5% and 6%, between 6% and 7%, between 7% and 8%, between 8% and 9%, between 9% and 10%, between 10% and 11%, between 11% and 12%, between 12% and 13%, between 13% and 14%, between 14% and 15%, between 15% and 16%, between 16% and 17%, between 17% and 18%, between 18% and 19%, between 19% and 20%, between 20% and 21%, between 21% and 22%, between 22% and 23%, between 23% and 24%, between 24% and 25%, between 25% and 26%, between 26% and 27%, between 27% and 28%, between 28% and 29%, between 29% and 30%, greater than that of a control corn plant grown under comparable conditions.

In an aspect, a modified, transgenic, or genome edited/mutated corn plant exhibits an increased yield relative to a control corn plant.

According to an aspect of the present disclosure, a modified, transgenic, or genome edited/mutated corn plant exhibits an increased yield by at least 1%, at least 3%, at least 5%, at least 7%, at least 9%, at least 11%, at least 13%, at least 15%, at least 17%, at least 19%, at least 21%, at least 23%, at least 25%, at least 27%, at least 29%, at least 31%, at least 33%, at least 35%, at least 37%, at least 39%, at least 41%, at least 43%, at least 45%, at least 47%, at least 49%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits a yield that is between 1% and 100%, between 3% and 100%, between 5% and 100%, between 7% and 100%, between 9% and 100%, between 11% and 100%, between 13% and 100%, between 15% and 100%, between 17% and 100%, between 19% and 100%, between 21% and 100%, between 23% and 100%, between 25% and 100%, between 27% and 100%, between 29% and 100%, between 31% and 100%, between 33% and 100%, between 35% and 100%, between 37% and 100%, between 39% and 100%, between 41% and 100%, between 43% and 100%, between 45% and 100%, between 47% and 100%, between 49% and 100%, between 50% and 100%, between 55% and 100%, between 60% and 100%, between 65% and 100%, between 70% and 100%, between 75% and 100%, between 80% and 100%, between 85% and 100%, between 90% and 100%, between 95% and 100%, greater than that of a control corn plant grown under comparable conditions.

According to an aspect of the present disclosure, a modified, transgenic, or genome edited/mutated corn plant exhibits a yield that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 49%, between 1% and 47%, between 1% and 45%, between 1% and 43%, between 1% and 41%, between 1% and 39%, between 1% and 37%, between 1% and 35%, between 1% and 33%, between 1% and 31%, between 1% and 29%, between 1% and 27%, between 1% and 25%, between 1% and 23%, between 1% and 21%, between 1% and 19%, between 1% and 17%, between 1% and 15%, between 1% and 13%, between 1% and 11%, between 1% and 9%, between 1% and 7%, between 1% and 5%, or between 1% and 3%, greater than that of a control corn plant grown under comparable conditions.

According to an aspect of the present disclosure, a modified, transgenic, or genome edited/mutated corn plant exhibits a yield that is between 3% and 95%, between 5% and 90%, between 7% and 85%, between 9% and 80%, between 11% and 75%, between 13% and 70%, between 15% and 65%, between 17% and 60%, between 19% and 55%, between 21% and 50%, between 23% and 49%, between 25% and 47%, between 27% and 45%, between 29% and 43%, between 31% and 41%, between 33% and 39%, or between 35% and 37%, greater than that of a control corn plant grown under comparable conditions.

According to an aspect of the present disclosure, a modified, transgenic, or genome edited/mutated corn plant exhibits a yield that is between 1% and 7%, between 7% and 13%, between 13% and 19%, between 19% and 25%, between 25% and 31%, between 31% and 37%, between 37% and 43%, between 43% and 49%, between 49% and 55%, between 55% and 60%, between 60% and 65%, between 65% and 70%, between 70% and 75%, between 75% and 80%, between 80% and 85%, between 85% and 90%, between 90% and 95%, or between 95% and 100%, greater than that of a control corn plant grown under comparable conditions.

In an aspect, modified, transgenic, or genome edited/mutated corn plants exhibit increased kernels per field area relative to control corn plants.

According to an aspect of the present disclosure, modified, transgenic, or genome edited/mutated corn plants exhibit increased kernels per field area by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to control corn plants.

According to an aspect of the present disclosure, modified, transgenic, or genome edited/mutated corn plants exhibit kernels per field area that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 21% and 100%, between 22% and 100%, between 23% and 100%, between 24% and 100%, between 25% and 100%, between 26% and 100%, between 27% and 100%, between 28% and 100%, between 29% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of control corn plants grown under comparable conditions.

According to an aspect of the present disclosure, modified, transgenic, or genome edited/mutated corn plants exhibit kernels per field area that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 29%, between 1% and 28%, between 1% and 27%, between 1% and 26%, between 1% and 25%, between 1% and 24%, between 1% and 23%, between 1% and 22%, between 1% and 21%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of control corn plants grown under comparable conditions.

According to an aspect of the present disclosure, modified, transgenic, or genome edited/mutated corn plants exhibit kernels per field area that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of control corn plants grown under comparable conditions.

According to an aspect of the present disclosure, modified, transgenic, or genome edited/mutated corn plants exhibit kernels per field area that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of control corn plants grown under comparable conditions.

According to an aspect of the present disclosure, modified, transgenic, or genome edited/mutated corn plants exhibit kernels per field area that is between 1% and 3%, between 3% and 5%, between 5% and 7%, between 7% and 9%, between 9% and 11%, between 11% and 13%, between 13% and 15%, between 15% and 17%, between 17% and 19%, between 19% and 21%, between 21% and 23%, between 23% and 25%, between 25% and 27%, between 27% and 29%, or between 29% and 30% greater than that of control corn plants grown under comparable conditions.

A modified, transgenic, or genome edited/mutated corn plant disclosed in the present disclosure can display a positive trait interaction in which a trait, such as a positive or negative trait, attributable to one or more transgenes (or one or more mutations or edits) can be enhanced, outperformed, neutralized, offset or mitigated due to the presence of one or more additional transgenes (or one or more additional mutations or edits). Such a transgenic and/or genome edited/mutated corn plant can exhibit improved ear traits as compared to a control corn plant comprising only one or two transgenes (or one or two mutations or edits). For example, GA20Ox_SUP/PpCOL/ZMM19 stack plants may have enhanced traits and/or positive traits relative to PpCOL single, GA20Ox_SUP single, and ZMM19 single plants, in terms of increased ear area, increased ear volume, increased single kernel weight, increased ear fresh weight, increased ear diameter, increased ear length, increased yield, increased kernels per ear, decreased ear tip void, and decreased ear void.

In another aspect, a modified, transgenic, or genome edited/mutated corn plant of the present disclosure exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased seed number, increased seed weight, increased prolificacy, and a combination thereof, relative to a control corn plant.

In yet another aspect, a modified, transgenic, or genome edited/mutated corn plant of the present disclosure does not have any significant off-types in at least one female organ or ear.

According to an aspect of the present disclosure, a modified, transgenic, or genome edited/mutated corn plant has no or reduced adverse effect over a trait or phenotype selected from the group consisting of senescence, delayed flowering, fungal infection, and a combination thereof, relative to a control corn plant.

Short stature or semi-dwarf corn plants can also have one or more additional traits, including increased stem diameter, reduced green snap, deeper roots, increased leaf area, earlier canopy closure, higher stomatal conductance, lower ear height, increased foliar water content, improved drought tolerance, increased nitrogen use efficiency, increased water use efficiency, reduced anthocyanin content and area in leaves under normal or nitrogen or water limiting stress conditions, increased ear weight, increased kernel number, increased kernel weight, increased yield, and/or increased harvest index.

According to an aspect of the present disclosure, a modified, transgenic, or genome edited/mutated corn plant provided herein comprises a harvest index of at least 0.57, at least 0.58, at least 0.59, at least 0.60, at least 0.61, at least 0.62, at least 0.63, at least 0.64, or at least 0.65. According to another aspect of the present disclosure a modified, transgenic, or genome edited/mutated corn plant provided herein comprises a harvest index of between 0.57 and 0.65, between 0.57 and 0.64, between 0.57 and 0.63, between 0.57 and 0.62, between 0.57 and 0.61, between 0.57 and 0.60, between 0.57 and 0.59, between 0.57 and 0.58, between 0.58 and 0.65, between 0.59 and 0.65, or between 0.60 and 0.65. According to yet another aspect of the present disclosure, a modified, transgenic, or genome edited/mutated corn plant provided herein comprises a harvest index that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 20%, at least 25%, at least 30%, at least 35%, at least 40%, at least 45%, or at least 50% greater as compared to an unmodified control plant. According to still another aspect of the present disclosure, a modified, transgenic, or genome edited/mutated corn plant provided herein comprises a harvest index that is between 1% and 45%, between 1% and 40%, between 1% and 35%, between 1% and 30%, between 1% and 25%, between 1% and 20%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, between 1% and 2%, between 5% and 15%, between 5% and 20%, between 5% and 30%, or between 5% and 40% greater as compared to a control plant.

According to another aspect of the present disclosure, methods are provided for planting a modified or transgenic plant(s) provided herein at a normal/standard or high density in field. According to some aspects, the yield of a crop plant per acre (or per land area) can be increased by planting a modified or transgenic plant(s) of the present disclosure at a higher density in the field. As described herein, modified or transgenic plants expressing a transcribable DNA sequence that encodes a non-coding RNA molecule targeting one or more endogenous GA20 and/or GA3 oxidase gene for suppression, a transgene encoding one or more CO or COL polypeptides, and a transgene encoding one or more MADS-box polypeptides, can have reduced plant height, shorter internode(s), increased stalk/stem diameter, and/or increased lodging resistance. Modified or transgenic plants described herein can tolerate high density planting conditions since an increase in stem diameter can resist lodging and the shorter plant height can allow for increased light penetrance to the lower leaves under high density planting conditions. Thus, modified or transgenic plants provided herein can be planted at a higher density to increase the yield per acre (or land area) in the field. For row crops, higher density can be achieved by planting a greater number of seeds/plants per row length and/or by decreasing the spacing between rows. In an aspect, the row spacing for high density planting of the modified, transgenic, or genome edited/mutated corn plants is less than or equal to 40 inches. In an aspect, the row spacing for high density planting of the modified, transgenic, or genome edited/mutated corn plants is less than or equal to 30 inches. In another aspect, the row spacing for high density planting of the modified, transgenic, or genome edited/mutated corn plants is less than or equal to 20 inches.

According to an aspect, seeds of a modified or transgenic crop plants can be planted at a density in the field (plants per land/field area) that is at least 5%, 10%, 15%, 20%, 25%, 50%, 75%, 100%, 125%, 150%, 175%, 200%, 225%, or 250% higher than the normal planting density for that crop plant according to standard agronomic practices. A modified or transgenic crop plant can be planted at a density in the field of at least 38,000 plants per acre, at least 40,000 plants per acre, at least 42,000 plants per acre, at least 44,000 plants per acre, at least 45,000 plants per acre, at least 46,000 plants per acre, at least 48,000 plants per acre, 50,000 plants per acre, at least 52,000 plants per acre, at least 54,000 per acre, or at least 56,000 plants per acre.

As an example, seeds of corn plants can be planted at a higher density, such as in a range from about 38,000 plants per acre to about 60,000 plants per acre, or about 40,000 plants per acre to about 58,000 plants per acre, or about 42,000 plants per acre to about 58,000 plants per acre, or about 40,000 plants per acre to about 45,000 plants per acre, or about 45,000 plants per acre to about 50,000 plants per acre, or about 50,000 plants per acre to about 58,000 plants per acre, or about 52,000 plants per acre to about 56,000 plants per acre, or about 38,000 plants per acre, about 42,000 plant per acre, about 46,000 plant per acre, or about 48,000 plants per acre, about 50,000 plants per acre, or about 52,000 plants per acre, or about 54,000 plant per acre, as opposed to a standard density range, such as about 18,000 plants per acre to about 38,000 plants per acre.

Exemplary Embodiments

The following list provides exemplary embodiments:

Embodiment 1. A modified corn plant or a plant part thereof comprising 1) a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes, 2) a second recombinant expression cassette comprising a first DNA sequence encoding a CONSTANS (CO) or CONSTANS-like (COL) polypeptide, and 3) a third recombinant expression cassette comprising a second DNA sequence encoding a MADS-box polypeptide.

Embodiment 2. The modified corn plant of Embodiment 1, wherein the first, second and third recombinant expression cassettes are stably integrated into the genome of the corn plant or plant part thereof.

Embodiment 3. The modified corn plant or plant part thereof of Embodiment 1, wherein the modified corn plant is semi-dwarf and has one or more improved ear traits, relative to a control corn plant that does not have the first, second or third recombinant expression cassette.

Embodiment 4. The modified corn plant or plant part thereof of Embodiment 1, 2, or 3, wherein the transcribable DNA sequence encodes a non-coding RNA for suppression of a GA3 oxidase gene.

Embodiment 5. The modified corn plant or plant part thereof of Embodiment 4, wherein the transcribable DNA sequence encodes a non-coding RNA for suppression of a GA3 oxidase_1 gene, a GA3 oxidase_2 gene, or both.

Embodiment 6. The modified corn plant or plant part thereof of Embodiment 5, wherein the transcribable DNA sequence comprises a sequence that is at least 80%, at least 85%, at least 90%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37.

Embodiment 7. The modified corn plant or plant part thereof of Embodiment 5, wherein the transcribable DNA sequence encodes a non-coding RNA comprising a sequence that is 80% complementary to at least 15 consecutive nucleotides of one or more of SEQ ID NOs: 28, 29, 31, 32, 36, and 37.

Embodiment 8. The modified corn plant or plant part thereof of any one of Embodiments 1 to 5, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 30 or 33.

Embodiment 9. The modified corn plant or plant part thereof of any one of Embodiments 1 to 5, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 28, 29, 31, or 32.

Embodiment 10. The modified corn plant or plant part thereof of Embodiment 1, 2, or 3, wherein the transcribable DNA sequence encodes a non-coding RNA for suppression of a GA20 oxidase gene.

Embodiment 11. The modified corn plant or plant part thereof of Embodiment 10, wherein the transcribable DNA sequence encodes a non-coding RNA for suppression of a GA20 oxidase_3 gene.

Embodiment 12. The modified corn plant or plant part thereof of Embodiment 10, wherein the transcribable DNA sequence encodes a non-coding RNA for suppression of a GA20 oxidase_4 gene.

Embodiment 13. The modified corn plant or plant part thereof of Embodiment 10, wherein the transcribable DNA sequence encodes a non-coding RNA for suppression of a GA20 oxidase_5 gene.

Embodiment 14. The modified corn plant or plant part thereof of Embodiment 10, wherein the transcribable DNA sequence encodes a non-coding RNA for suppression of a GA20 oxidase_3 gene, a GA20 oxidase_5 gene, or both.

Embodiment 15. The modified corn plant or plant part thereof of Embodiment 14, wherein the transcribable DNA sequence comprises a sequence that is at least 60% identical or complementary to at least 15 consecutive nucleotides of SEQ ID NO: 39, 53, or 55.

Embodiment 16. The modified corn plant or plant part thereof of Embodiment 14, wherein the transcribable DNA sequence encodes a sequence that is at least 60% identical or complementary to at least 15 consecutive nucleotides of SEQ ID NO: 40, 54, or 56.

Embodiment 17. The modified corn plant or plant part thereof of any one of Embodiments 10 to 14, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, or 15.

Embodiment 18. The modified corn plant or plant part thereof of any one of Embodiments 10 to 14, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, or 14.

Embodiment 19. The modified corn plant or plant part thereof of any one of Embodiments 1 to 18, wherein the CO or COL polypeptide comprises a *Physcomitrella patens* CONSTANS-like 1 (PpCOL1) polypeptide.

Embodiment 20. The modified corn plant or plant part thereof of Embodiment 19, wherein the first DNA sequence of the second recombinant expression cassette comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 21. The modified corn plant or plant part thereof of Embodiment 19, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 22. The modified corn plant or plant part thereof of any one of Embodiments 1 to 21, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 23. The modified corn plant or plant part thereof of any one of Embodiments 1 to 21, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 24. The modified corn plant or plant part thereof of any one of Embodiments 1 to 23 wherein the MADS-box polypeptide comprises a maize ZMM19 polypeptide.

Embodiment 25. The modified corn plant or plant part thereof of Embodiment 24, wherein the second DNA sequence of the third recombinant expression cassette comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 26. The modified corn plant or plant part thereof of Embodiment 24, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NO: 176, Embodiment 27. The modified corn plant or plant part thereof of any one of Embodiments 1 to 26, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 28. The modified corn plant or plant part thereof of any one of Embodiments 1 to 27, wherein the expression level of an endogenous GA20 oxidase or GA3 oxidase gene is reduced or eliminated in the modified corn plant or plant part thereof.

Embodiment 29. The modified corn plant or plant part thereof of Embodiment 28, wherein the transcribable DNA sequence encoding the non-coding RNA for suppression of the one or more GA20 oxidase genes and/or one or more GA3 oxidase genes is operably linked to a heterologous plant-expressible promoter.

Embodiment 30. The modified corn plant or plant part thereof of Embodiment 29, wherein the heterologous plant-expressible promoter is a vascular promoter.

Embodiment 31. The modified corn plant or plant part thereof of Embodiment 30, wherein the vascular promoter is selected from the group consisting of a sucrose synthase promoter, a sucrose transporter promoter, a Sh1 promoter, Commelina yellow mottle virus (CoYMV) promoter, a wheat dwarf geminivirus (WDV) large intergenic region (LIR) promoter, a maize streak geminivirus (MSV) coat polypeptide (CP) promoter, a rice yellow stripe 1 (YS1)-like promoter, a rice yellow stripe 2 (OsYSL2) promoter, and a combination therof.

Embodiment 32. The modified corn plant or plant part thereof of Embodiment 31, wherein the vascular promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 67, SEQ ID NO: 68, SEQ ID NO: 69, SEQ ID NO: 70 or SEQ ID NO: 71, or a functional portion thereof.

Embodiment 33. The modified corn plant or plant part thereof of Embodiment 29, wherein the heterologous plant-expressible promoter is a rice tungro bacilliform virus (RTBV) promoter.

Embodiment 34. The modified corn plant or plant part thereof of Embodiment 33, wherein RTBV promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 65 or SEQ ID NO: 66, or a functional portion thereof.

Embodiment 35. The modified corn plant or plant part thereof of Embodiment 29, wherein the heterologous plant-expressible promoter is a leaf promoter.

Embodiment 36. The modified corn plant or plant part thereof of Embodiment 35, wherein the leaf promoter is selected from the group consisting of a RuBisCO promoter, a pyruvate phosphate dikinase (PPDK) promoter, a fructose 1-6 bisphosphate aldolase (FDA) promoter, a Nadh-Gogat promoter, a chlorophyll a/b binding polypeptide gene promoter, a phosphoenolpyruvate carboxylase (PEPC) promoter, a Myb gene promoter, and a combination thereof.

Embodiment 37. The modified corn plant or plant part thereof of Embodiment 36, wherein the leaf promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 72, SEQ ID NO: 73 or SEQ ID NO: 74, or a functional portion therof.

Embodiment 38. The modified corn plant or plant part thereof of Embodiment 29, wherein the heterologous plant-expressible promoter is a constitutive promoter.

Embodiment 39. The modified corn plant or plant part thereof of Embodiment 38, wherein the constitutive promoter is selected from the group consisting of an actin promoter, a Cauliflower mosaic virus (CaMV) 35S or 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, or a maize alcohol dehydrogenase, a functional portion thereof, and a combination thereof.

Embodiment 40. The modified corn plant or plant part thereof of Embodiment 39, wherein the constitutive promoter comprises a DNA sequence that is at least 80%, at least 85%, at least 90%, at least 95%, at least 96%, at least 97%, at least 98%, at least 99%, at least 99.5% or 100% identical to one or more of SEQ ID NOs: 75, SEQ ID NO: 76, SEQ ID NO: 77, SEQ ID NO: 78, SEQ ID NO: 79, SEQ ID NO: 80, SEQ ID NO: 81, SEQ ID NO: 82 or SEQ ID NO: 83, or a functional portion therof.

Embodiment 41. The modified corn plant or plant part thereof of any one of Embodiments 1 to 40, wherein the non-coding RNA is a precursor miRNA or siRNA capable of being processed or cleaved to form a mature miRNA or siRNA.

Embodiment 42. The modified corn plant or plant part thereof of Embodiment 41, wherein the first DNA sequence is linked to a second heterologous plant-expressible promoter and the second DNA sequence is operably linked to a third heterologous plant-expressible promoter.

Embodiment 43. The modified corn plant or plant part thereof of Embodiment 42, wherein the second or third heterologous plant-expressible promoter is a constitutive promoter.

Embodiment 44. The modified corn plant or plant part thereof of Embodiment 43, wherein the constitutive promoter is selected from the group consisting of an actin promoter, a Cauliflower mosaic virus (CaMV) 35S or 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, or a maize alcohol dehydrogenase, a functional portion thereof, and a combination therof.

Embodiment 45. The modified corn plant or plant part thereof of Embodiment 42, wherein the second heterologous plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 172 or a functional portion thereof.

Embodiment 46. The modified corn plant or plant part thereof of Embodiment 42, wherein the third heterologous plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 178 or a functional portion thereof.

Embodiment 47. The modified corn plant or plant part thereof of Embodiment 42, wherein the second or third heterologous plant-expressible promoter is a vascular promoter.

Embodiment 48. The modified corn plant or plant part thereof of Embodiment 47, wherein the vascular promoter is selected from the group consisting of a sucrose synthase promoter, a sucrose transporter promoter, a Sh1 promoter, Commelina yellow mottle virus (CoYMV) promoter, a wheat dwarf geminivirus (WDV) large intergenic region (LIR) promoter, a maize streak geminivirus (MSV) coat polypeptide (CP) promoter, a rice yellow stripe 1 (YS1)-like promoter, a rice yellow stripe 2 (OsYSL2) promoter, and a combination therof.

Embodiment 49. The modified corn plant or plant part thereof of Embodiment 48, wherein the vascular promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 67, SEQ ID NO: 68, SEQ ID NO: 69, SEQ ID NO: 70 or SEQ ID NO: 71, or a functional portion therof.

Embodiment 50. The modified corn plant or plant part thereof of Embodiment 42, wherein the third heterologous plant-expressible promoter is a root promoter.

Embodiment 51. The modified corn plant or plant part thereof of Embodiment 50, wherein the root promoter comprises a DNA sequence that is at least 80%, at least 85%, at least 90%, at least 95%, at least 96%, at least 97%, at least 98%, at least 99%, at least 99.5%, or 100% identical to SEQ ID NO: 178 or a functional portion therof.

Embodiment 52. The modified corn plant or plant part thereof of Embodiment 42, wherein the second heterologous plant-expressible promoter is a leaf promoter.

Embodiment 53. The modified corn plant or plant part thereof of Embodiment 52, wherein the leaf promoter is selected from the group consisting of a RuBisCO promoter, a pyruvate phosphate dikinase (PPDK) promoter, a fructose 1-6 bisphosphate aldolase (FDA) promoter, a Nadh-Gogat promoter, a chlorophyll a/b binding polypeptide gene promoter, a phosphoenolpyruvate carboxylase (PEPC) promoter, a Myb gene promoter, and a combination thereof.

Embodiment 54. The modified corn plant or plant part thereof of Embodiment 53, wherein the leaf promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 72, SEQ ID NO: 73 or SEQ ID NO: 74, or a functional portion thereof.

Embodiment 55. The modified corn plant or plant part thereof of Embodiment 42, wherein the second or third heterologous plant-expressible promoter is a meristem promoter.

Embodiment 56. The modified corn plant or plant part thereof of Embodiment 55, wherein the meristem promoter is a meristem-preferred promoter or a meristem-specific promoter.

Embodiment 57. The modified corn plant or plant part thereof of Embodiment 55 or 56, wherein the meristem promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or both of SEQ ID NOs: 484 and 485, or a functional portion thereof.

Embodiment 58. The modified corn plant or plant part thereof of Embodiment 42, wherein the second or third heterologous plant-expressible promoter is a seed promoter or a kernel promoter.

Embodiment 59. The modified corn plant or plant part thereof of Embodiment 58, wherein the seed promoter or kernel promoter is a seed-preferred promoter or a kernel-preferred promoter.

Embodiment 60. The modified corn plant or plant part thereof of Embodiment 58, wherein the seed promoter or kernel promoter is a seed-specific promoter or a kernel-specific promoter.

Embodiment 61. The modified corn plant or plant part thereof of any one of Embodiments 58 to 60, wherein the seed promoter or the kernel promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 486-491, or a functional portion thereof.

Embodiment 62. The modified corn plant or plant part thereof of any one of Embodiments 1 to 61, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

Embodiment 63. The modified corn plant or plant part thereof of any one of Embodiments 1 to 62, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

Embodiment 64. The modified corn plant or plant part thereof of any one of Embodiments 1 to 63, wherein the modified corn plant exhibits improved lodging resistance, reduced green snap, or both, relative to a control corn plant.

Embodiment 65. The modified corn plant or plant part thereof of any one of Embodiments 1 to 64, wherein the modified corn plant exhibits increased ear area relative to a control corn plant.

Embodiment 66. The modified corn plant or plant part thereof of any one of Embodiments 1 to 65, wherein the modified corn plant exhibits an increase in ear area by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to a control corn plant.

Embodiment 67. The modified corn plant or plant part thereof of any one of Embodiments 1 to 66, wherein the modified corn plant exhibits increased single kernel weight relative to a control corn plant.

Embodiment 68. The modified corn plant or plant part thereof of any one of Embodiments 1 to 67, wherein the modified corn plant exhibits an increase in singe kernel weight by at least at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to a control corn plant.

Embodiment 69. The modified corn plant or plant part thereof of any one of Embodiments 1 to 68, wherein the modified corn plant exhibits increased ear fresh weight relative to a control corn plant.

Embodiment 70. The modified corn plant or plant part thereof of any one of Embodiments 1 to 69, wherein the modified corn plant exhibits increased ear fresh weight by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to a control corn plant.

Embodiment 71. The modified corn plant or plant part thereof of any one of Embodiments 1 to 70, wherein the modified corn plant exhibits increased ear diameter relative to a control corn plant.

Embodiment 72. The modified corn plant or plant part thereof of any one of Embodiments 1 to 71, wherein the modified corn plant exhibits increased ear diameter by at least 0.2%, at least 0.4%, at least 0.6%, at least 0.8%, at least 1.0%, at least 1.2%, at least 1.4%, at least 1.6%, at least 1.8%, at least 2.0%, at least 2.2%, at least 2.4%, at least 2.6%, at least 2.8%, at least 3.0%, at least 3.2%, at least 3.4%, at least 3.6%, at least 3.8%, or at least 4.0%, relative to the control corn plant.

Embodiment 73. The modified corn plant or plant part thereof of any one of Embodiments 1 to 72, wherein the modified corn plant exhibits increased ear length relative to a control corn plant.

Embodiment 74. The modified corn plant or plant part thereof of any one of Embodiments 1 to 73, wherein the modified corn plant exhibits an increased ear length by at least 1%, at least 2%, at least 3%, at least 4%, at least 5%, at least 6%, at least 7%, at least 8%, at least 9%, at least 10%, at least 11%, at least 12%, at least 13%, at least 14%, or at least 15%, at least 16%, at least 17%, at least 18%, at least 19%, or at least 20%, relative to the control corn plant.

Embodiment 75. The modified corn plant or plant part thereof of any one of Embodiments 1 to 74, wherein the modified corn plant exhibits increased ear volume relative to a control corn plant.

Embodiment 76. The modified corn plant or plant part thereof of Embodiment 75, wherein the modified corn plant exhibits an increase in ear volume by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to the control corn plant.

Embodiment 77. The modified corn plant or plant part thereof of any one of Embodiments 1 to 76, wherein the modified corn plant exhibits increased yield relative to a control corn plant.

Embodiment 78. The modified corn plant or plant part thereof of Embodiment 77, wherein the modified corn plant exhibits an increase in yield by at least 1%, at least 3%, at least 5%, at least 7%, at least 9%, at least 11%, at least 13%, at least 15%, at least 17%, at least 19%, at least 21%, at least 23%, at least 25%, at least 27%, at least 29%, at least 31%, at least 33%, at least 35%, at least 37%, at least 39%, at least 41%, at least 43%, or at least 45%, relative to the control corn plant.

Embodiment 79. The modified corn plant or plant part thereof of any one of Embodiments 1 to 78, wherein the modified corn plant exhibits increased number of kernels per ear relative to a control corn plant.

Embodiment 80. The modified corn plant or plant part thereof of Embodiment 79, wherein the modified corn plant exhibits an increase in number of kernels per ear by at least 1%, at least 2%, at least 3%, at least 4%, at least 5%, at least 6%, at least 7%, at least 8%, at least 9%, at least 10%, at least 11%, at least 12%, at least 13%, at least 14%, or at least 15%, at least 16%, at least 17%, at least 18%, at least 19%, or at least 20%, relative to the control corn plant.

Embodiment 81. The modified corn plant or plant part thereof of any one of Embodiments 1 to 80, wherein the modified corn plant exhibits decreased ear tip void relative to a control corn plant.

Embodiment 82. The modified corn plant or plant part thereof of Embodiment 81, wherein the modified corn plant exhibits a decrease in ear tip void by at least 1%, at least 2%, at least 3%, at least 4%, at least 5%, at least 6%, at least 7%, at least 8%, at least 9%, at least 10%, at least 11%, at least 12%, at least 13%, at least 14%, or at least 15%, at least 16%, at least 17%, at least 18%, at least 19%, or at least 20%, relative to the control corn plant.

Embodiment 83. The modified corn plant or plant part thereof of any one of Embodiments 1 to 82, wherein the modified corn plant exhibits decreased ear void relative to a control corn plant.

Embodiment 84. The modified corn plant or plant part thereof of Embodiment 83, wherein the modified corn plant exhibits a decrease in ear void by at least 1%, at least 2%, at least 3%, at least 4%, at least 5%, at least 6%, at least 7%, at least 8%, at least 9%, at least 10%, at least 11%, at least 12%, at least 13%, at least 14%, or at least 15%, at least 16%, at least 17%, at least 18%, at least 19%, or at least 20%, relative to the control corn plant.

Embodiment 85. The modified corn plant or plant part thereof of any one of Embodiments 1 to 84, wherein the modified corn plant does not have any significant off-types in at least one female organ or ear.

Embodiment 86. A seed of the modified corn plant of any one of Embodiments 1 to 85, wherein the seed comprises the first, second, and third recombinant expression cassettes.

Embodiment 87. The seed of Embodiment 86, wherein a progeny plant grown from the seed is semi-dwarf and has one or more improved ear traits, relative to a control corn plant that does not comprise the first, second, or third recombinant expression cassette.

Embodiment 88. A commodity or commodity product produced from the seed of Embodiment 86, comprising the first, second, and third recombinant expression cassettes.

Embodiment 89. A method comprising planting the seed of Embodiment 86 in a growth medium or soil.

Embodiment 90. The method of Embodiment 89, further comprising planting a plurality of the seeds with a row spacing of less than or equal to 40 inches.

Embodiment 91. The method of Embodiment 89, further comprising planting a plurality of the seeds with a row spacing of less than or equal to 30 inches.

Embodiment 92. The method of Embodiment 91, wherein the row spacing is less than or equal to 20 inches.

Embodiment 93. The method of Embodiment 89, further comprising growing a corn plant from the seed.

Embodiment 94. The method of Embodiment 93, further comprising harvesting a seed from the corn plant.

Embodiment 95. The method of any one of Embodiments 90 to 94, wherein the seed is planted at a density selected from the group consisting of at least 38,000 plants per acre, at least 40,000 plants per acre, at least 42,000 plants per acre, at least 44,000 plants per acre, at least 45,000 plants per acre, at least 46,000 plants per acre, at least 48,000 plants per acre, 50,000 plants per acre, at least 52,000 plants per acre, at least 54,000 per acre, and at least 56,000 plants per acre.

Embodiment 96. A plurality of modified corn plants in a field, each modified corn plant comprising 1) a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes,
2) a second recombinant expression cassette comprising a first DNA sequence encoding a CO or COL polypeptide, and
3) a third recombinant expression cassette comprising a second DNA sequence encoding a MADS-box polypeptide.

Embodiment 97. The plurality of modified corn plants of Embodiment 96, wherein the modified corn plants have increased yield relative to control corn plants.

Embodiment 98. The plurality of modified corn plants of Embodiment 96 or 97, wherein the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

Embodiment 99. A method for producing a modified corn plant, the method comprising:
a. introducing into a corn cell a first recombinant expression cassette comprising a coding sequence for a CO or COL polypeptide, wherein the corn cell comprises a second recombinant expression cassette comprising a transcribable DNA sequence encoding a non-coding RNA for suppression of one or more GA3 oxidase genes and/or one or more GA20 oxidase genes and a third recombinant expression cassette comprising a coding sequence for a MADS-box polypeptide; and
b. regenerating or developing a modified corn plant from the corn cell, wherein the modified corn plant comprises the first, second and third recombinant expression cassettes.

Embodiment 100. A method for producing a modified corn plant, the method comprising:
a. introducing into a corn cell a first recombinant expression cassette comprising a coding sequence for a MADS-box polypeptide, wherein the corn cell comprises a second recombinant expression cassette comprising a transcribable DNA sequence encoding a non-coding RNA for suppression of one or more GA3 oxidase genes and/or one or more GA20 oxidase genes and a third recombinant expression cassette comprising a coding sequence for a CO or COL polypeptide; and
b. regenerating or developing a modified corn plant from the corn cell, wherein the modified corn plant comprises the first, second, and third recombinant expression cassettes.

Embodiment 101. A method for producing a modified corn plant, the method comprising:
a. introducing into a corn cell a first recombinant expression cassette comprising a transcribable DNA sequence encoding a non-coding RNA for suppression of one or more GA3 oxidase genes and/or one or more GA20 oxidase genes, wherein the corn cell comprises a second recombinant expression cassette comprising a coding sequence for a MADS-box polypeptide and a third recombinant expression cassette comprising a coding sequence for a CO or COL polypeptide; and b. regenerating or developing a modified corn plant from the corn cell, wherein the modified corn plant comprises the first, second, and third recombinant expression cassettes.

Embodiment 102. A method for producing a modified corn plant, the method comprising:
a. introducing into a corn cell 1) a first recombinant expression cassette comprising a transcribable DNA sequence encoding a non-coding RNA for suppression of one or more GA3 oxidase genes and/or GA20 oxidase genes, 2) a second recombinant expression cassette comprising a coding sequence for a CO or COL polypeptide, and 3) a third recombinant expression cassette comprising a coding sequence for a MADS-box polypeptide; and
b. regenerating or developing a modified corn plant from the corn cell, wherein the modified corn plant comprises the first, second, and third recombinant expression cassettes.

Embodiment 103. The method of any one of Embodiments 99 to 102, wherein the introducing is via site-directed integration using a site-specific nuclease.

Embodiment 104. The method of Embodiment 103, wherein the site-specific nuclease is selected from the group consisting of a RNA-guided endonuclease, a meganuclease, a zinc-finger nuclease (ZFN), a TALE-endonuclease (TALEN), a recombinase, and a transposase.

Embodiment 105. The method of any one of Embodiments 99 to 102, wherein the introducing is via *Agrobacterium*-mediated transformation.

Embodiment 106. The method of any one of Embodiments 99 to 102, wherein the introducing is via particle bombardment.

Embodiment 107. The method of any one of Embodiments 99 to 106, wherein the transcribable DNA sequence encodes a non-coding RNA for suppression of a GA3 oxidase_1 gene, a GA3 oxidase_2 gene, or both.

Embodiment 108. The method of Embodiment 107, wherein the transcribable DNA sequence comprises a sequence that is at least 80%, at least 85%, at least 90%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37.

Embodiment 109. The method of Embodiment 107, wherein the transcribable DNA sequence encodes a non-coding RNA comprising a sequence that is 80% complementary to at least 15 consecutive nucleotides of one or more of SEQ ID NOs: 28, 29, 31, 32, 36, and 37.

Embodiment 110. The method of any one of Embodiments 99 to 106, wherein the transcribable DNA sequence encodes a non-coding RNA for suppression of a GA20 oxidase gene.

Embodiment 111. The method of Embodiment 110, wherein the transcribable DNA sequence encodes a non-coding RNA for suppression of a GA20 oxidase_3 gene, a GA20 oxidase_4 gene, a GA20 oxidase_5 gene, or a combination thereof.

Embodiment 112. The method of Embodiment 111, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, or 15.

Embodiment 113. The method of Embodiment 96 or 111, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, or 14.

Embodiment 114. The method of any one of Embodiments 99 to 113, wherein the CO or COL polypeptide comprises a *Physcomitrella patens* CONSTANS-like 1 (PpCOL1) polypeptide.

Embodiment 115. The method of Embodiment 114, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 116. The method of Embodiment 114, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 117. The method of any one of Embodiments 99 to 113, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 118. The method of any one of Embodiments 99 to 113, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 119. The method of any one of Embodiments 99 to 118, wherein the MADS-box polypeptide comprises a maize ZMM19 polypeptide.

Embodiment 120. The method of Embodiment 119, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 121. The method of Embodiment 119, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 122. The method of any one of Embodiments 99 to 118, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 123. The method of any one of Embodiments 99 to 122, wherein the first, second and third recombinant expression cassettes are stably integrated into the genome of the corn cell.

Embodiment 124. The method of any one of Embodiments 99 to 123, further comprising selecting a modified corn plant having a desired trait.

Embodiment 125. The method of Embodiment 124, wherein the selected modified corn plant is semi-dwarf and has one or more improved ear traits, relative to a control corn plant not having the first, second, or third recombinant expression cassette.

Embodiment 126. The method of Embodiment 124 or 125, wherein the selecting a modified corn plant having a desired trait comprises the use of one or more molecular techniques.

Embodiment 127. The method of Embodiment 126, wherein the one or more molecular techniques are selected from the group consisting of Southern analysis, polymerase chain reaction (PCR) amplification, Northern blots, RNase protection, primer extension, reverse transcription PCR (RT-PCR), Sanger sequencing, Next Generation sequencing technologies, enzymatic assays, protein gel electrophoresis, Western blots, immunoprecipitation, enzyme-linked immunoassays, in situ hybridization, enzyme staining, immunostaining, marker genotyping, and a combination thereof.

Embodiment 128. The method of any one of Embodiments 99 to 127, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

Embodiment 129. The method of any one of Embodiments 99 to 128, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

Embodiment 130. The method of any one of Embodiments 99 to 129, wherein the modified corn plant exhibits an ear trait selected from the group consisting of increased ear area, increased ear volume, increased single kernel weight, increased ear fresh weight increased ear diameter, increased ear length, increased yield, increased kernels per ear, decreased ear tip void, decreased ear void, and a combination thereof, relative to a control corn plant.

Embodiment 131. A method for producing a modified corn plant, the method comprising:
a. crossing a first modified corn plant with a second modified corn plant, wherein the expression or activity of one or more endogenous GA3 oxidase genes and/or GA20 oxidase genes is reduced in the first modified corn plant relative to a wildtype control, and wherein the second modified corn plant comprises a first recombinant expression cassette comprising a coding sequence for a CO or COL polypeptide and a second recombinant expression cassette comprising a coding sequence for a MADS-box polypeptide; and
b. producing a progeny corn plant comprising the first and second recombinant expression cassettes and has the reduced expression of the one or more endogenous GA3 oxidase genes and/or GA20 oxidase genes.

Embodiment 132. A method for producing a modified corn plant, the method comprising:
a. crossing a first modified corn plant with a second modified corn plant, wherein the first modified corn plant comprises a first recombinant expression cassette comprising a coding sequence for a CO or COL polypeptide, and wherein the second modified corn plant has its expression or activity of one or more endogenous GA3 oxidase genes and/or GA20 oxidase genes reduced relative to a wildtype control, and wherein the second modified corn plant comprises a second recombinant expression cassette comprising a coding sequence for a MADS-box polypeptide; and
b. producing a progeny corn plant comprising the first and second recombinant expression cassettes and has the reduced expression of the one or more endogenous GA3 oxidase genes and/or GA20 oxidase genes.

Embodiment 133. A method for producing a modified corn plant, the method comprising:
a. crossing a first modified corn plant with a second modified corn plant, wherein the first modified corn plant comprises a first recombinant expression cassette comprising a coding sequence for a MADS-box polypeptide, and wherein the second modified corn plant has its expression or activity of one or more endogenous GA3 oxidase genes and/or GA20 oxidase genes reduced relative to a wildtype control, and wherein the second modified corn plant comprises a second recombinant expression cassette comprising a coding sequence for a CO or COL polypeptide; and b. producing a progeny corn plant comprising the first and second recombinant expression cassettes and has the reduced expression of the one or more endogenous GA3 oxidase genes and/or GA20 oxidase genes.

Embodiment 134. A method for producing a modified corn plant, the method comprising a. performing one or more crossings using one or more modified corn plants, wherein the one or more modified corn plants are selected from the group consisting of:
  i. a modified corn plant that has its expression or activity of one or more endogenous GA3 oxidase genes and/or GA20 oxidase genes reduced relative to a wildtype control,
  ii. a modified corn plant comprising a recombinant expression cassette comprising a coding sequence for a CO or COL polypeptide,
  iii. a modified corn plant comprising a recombinant expression cassette comprising a coding sequence for a MADS-box polypeptide,
  iv. a modified corn plant that has its expression or activity of one or more endogenous GA3 oxidase genes and/or GA20 oxidase genes reduced relative to a wildtype control and comprises a recombinant expression cassette comprising a coding sequence for a CO or COL polypeptide,
  v. a modified corn plant that has its expression or activity of one or more endogenous GA3 oxidase genes and/or GA20 oxidase genes reduced relative to a wildtype control and comprises a recombinant expression cassette comprising a coding sequence for a MADS-box polypeptide, and
  vi. a modified corn plant comprising a first recombinant expression cassette comprising a coding sequence for a CO or COL polypeptide and a second recombinant expression cassette comprising a coding sequence for a MADS-box polypeptide, and b. producing a progeny corn plant comprising the first and second recombinant expression cassettes and has the reduced expression of the one or more endogenous GA3 oxidase genes and/or GA20 oxidase genes.

Embodiment 135. The method of any one of Embodiments 131 to 134, wherein the first and second modified corn plants or the one or more modified corn plants are obtained via site-directed integration using a site-specific nuclease.

Embodiment 136. The method of Embodiment 135, wherein the site-specific nuclease is selected from the group consisting of a RNA-guided endonuclease, a meganuclease, a zinc-finger nuclease (ZFN), a TALE-endonuclease (TALEN), a recombinase, and a transposase.

Embodiment 137. The method of any one of Embodiments 131 to 134, wherein the first and second modified corn plants or the one or more modified corn plants are obtained via *Agrobacterium*-mediated transformation.

Embodiment 138. The method of any one of Embodiments 131 to 134, wherein the first and second modified corn plants or the one or more modified corn plants are obtained via particle bombardment.

Embodiment 139. The method of Embodiment 131 to 138, wherein the progeny corn plant comprise a transcribable DNA sequence encoding a non-coding RNA for suppression of a GA3 oxidase_1 gene, a GA3 oxidase_2 gene, or both.

Embodiment 140. The method of Embodiment 139, wherein the transcribable DNA sequence comprises a sequence that is at least 80%, at least 85%, at least 90%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37.

Embodiment 141. The method of Embodiment 139, wherein the transcribable DNA sequence encodes a non-coding RNA comprising a sequence that is 80% complementary to at least 15 consecutive nucleotides of one or more of SEQ ID NOs: 28, 29, 31, 32, 36, and 37.

Embodiment 142. The method of any one of Embodiments 131 to 138, wherein the transcribable DNA sequence encodes a non-coding RNA for suppression of a GA20 oxidase gene.

Embodiment 143. The method of Embodiment 142, wherein the transcribable DNA sequence encodes a non-coding RNA for suppression of a GA20 oxidase_3 gene, a GA20 oxidase_4 gene, a GA20 oxidase_5 gene, or a combination thereof.

Embodiment 144. The method of Embodiment 143, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, or 15.

Embodiment 145. The method of Embodiment 143 or 131, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, or 14.

Embodiment 146. The method of any one of Embodiments 131 to 145, wherein the CO or COL polypeptide comprises a *Physcomitrella patens* CONSTANS-like 1 (PpCOL1) polypeptide.

Embodiment 147. The method of Embodiment 146, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 148. The method of Embodiment 146, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 149. The method of any one of Embodiments 131 to 146, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 150. The method of any one of Embodiments 131 to 146, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 151. The method of any one of Embodiments 131 to 150, wherein the MADS-box polypeptide comprises a maize ZMM19 polypeptide.

Embodiment 152. The method of Embodiment 151, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 153. The method of Embodiment 151, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 154. The method of any one of Embodiments 131 to 151, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 155. The method of any one of Embodiments 131 to 154, further comprising selecting a progeny corn plant having a desired trait.

Embodiment 156. The method of Embodiment 155, wherein the selected progeny corn plant is semi-dwarf and has one or more improved ear traits, relative to a control corn plant.

Embodiment 157. The method of Embodiment 155 or 156, wherein the selecting a progeny corn plant having a desired trait comprises the use of one or more molecular techniques.

Embodiment 158. The method of Embodiment 157, wherein the one or more molecular techniques are selected from the group consisting of Southern analysis, PCR amplification, Northern blots, RNase protection, primer extension, RT-PCR, Sanger sequencing, Next Generation sequencing technologies, enzymatic assays, protein gel electrophoresis, Western blots, immunoprecipitation, enzyme-linked immunoassays, in situ hybridization, enzyme staining, immunostaining, marker genotyping, and a combination thereof.

Embodiment 159. The method of any one of Embodiments 131 to 158, wherein the height at maturity of the progeny corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

Embodiment 160. The method of any one of Embodiments 131 to 159, wherein the stalk or stem diameter of the progeny corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

Embodiment 161. The method of any one of Embodiments 131 to 160, wherein the progeny corn plant exhibit an ear trait selected from the group consisting of increased ear area, increased ear volume, increased single kernel weight, increased ear fresh weight, increased ear diameter, increased ear length, increased yield, increased kernels per ear, decreased ear tip void, decreased ear void, and a combination thereof, relative to a control corn plant.

Embodiment 162. The method of any one of Embodiments 131 to 161, wherein the progeny corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

Embodiment 163. A method for producing a modified corn plant, the method comprising:

a. introducing into a corn cell a first recombinant expression cassette comprising a coding sequence for a CO or COL polypeptide operably linked to a first plant-expressible promoter, and wherein the corn cell comprises (1) one or more mutations and/or edits in one or more endogenous GA3 oxidase and/or GA20 oxidase genes and (2) a second recombinant expression cassette comprising a coding sequence for a MADS-box polypeptide operably linked to a second plant-expressible promoter; and b. regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

Embodiment 164. A method for producing a modified corn plant, the method comprising:

a. introducing into a corn cell a first recombinant expression cassette comprising a coding sequence for a MADS-box polypeptide operably linked to a first plant-expressible promoter, and wherein the corn cell comprises (1) one or more mutations and/or edits in one or more endogenous GA3 oxidase and/or GA20 oxidase genes and (2) a second recombinant expression cassette comprising a coding sequence for a CO or COL polypeptide operably linked to a second plant-expressible promoter; and b. regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

Embodiment 165. A method for producing a modified corn plant, the method comprising:

a. mutating or editing one or more endogenous GA3 oxidase genes and/or one or more GA20 oxidase genes in a corn cell, wherein the corn cell comprises (1) a first recombinant expression cassette comprising a encoding sequence for a CO or COL polypeptide operably linked to a first plant-expressible promoter and (2) a second recombinant expression cassette comprising a encoding sequence for a MADS-box polypeptide linked to a second plant-expressible promoter; and b. regenerating or developing a modified corn plant from the corn cell, wherein the modified corn plant comprises the first and second recombinant expression cassettes and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

Embodiment 166. The method of any one of Embodiments 163 to 165, wherein the mutating or editing is obtained by using a site-specific nuclease selected from the group consisting of a RNA-guided endonuclease, a meganuclease, a zinc-finger nuclease (ZFN), a TALE-endonuclease (TALEN), a recombinase, and a transposase.

Embodiment 167. The method of Embodiments 166, further comprising introducing a recombinant DNA construct encoding a guide RNA that targets the one or more endogenous GA3 oxidase and/or GA20 oxidase genes.

Embodiment 168. The method of Embodiment 166, wherein the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of a target DNA sequence at or near the genomic locus of one or more endogenous GA3 oxidase and/or GA20 oxidase genes.

Embodiment 169. The method of Embodiment 168, wherein the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of SEQ ID NO: 34, 35, 36, 37, or 38, or a sequence complementary thereto.

Embodiment 170. The method of any one of Embodiments 166 to 169, wherein the guide RNA is a CRISPR RNA (crRNA) or a single-chain guide RNA (sgRNA).

Embodiment 171. The method of any one of Embodiments 166 to 170, wherein the guide RNA comprises a sequence complementary to a protospacer adjacent motif (PAM) sequence present in the genome of the corn cell immediately adjacent to a target DNA sequence at or near the genomic locus of the one or more endogenous GA3 oxidase and/or GA20 oxidase genes.

Embodiment 172. The method of any one of Embodiments 166 to 171, wherein the one or more endogenous GA3 oxidase and/or GA20 oxidase genes encode a protein that is at least 80%, at least 85%, at least 90%, at least 95%, at least 96%, at least 97%, at least 98%, at least 99%, at least 99.5%, or 100% identical to SEQ ID NO: 9, 12, 15, 30, or 33.

Embodiment 173. The method of any one of Embodiments 163 to 164, wherein the introducing is via *Agrobacterium*-mediated transformation or particle bombardment.

Embodiment 174. The method of any one of Embodiments 163 to 173, wherein the CO or COL polypeptide comprises a *Physcomitrella patens* CONSTANS-like 1 (PpCOL1) polypeptide.

Embodiment 175. The method of Embodiment 174, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 176. The method of Embodiment 174, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 177. The method of any one of Embodiments 163 to 173, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 178. The method of any one of Embodiments 163 to 173, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 179. The method of any one of Embodiments 163 to 178, wherein the MADS-box polypeptide comprises a maize ZMM19 polypeptide Embodiment 180. The method of Embodiment 179, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 181. The method of Embodiment 179, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 182. The method of any one of Embodiments 163 to 177, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 183. The method of any one of Embodiments 163 to 182, further comprising selecting a modified corn plant having a desired trait.

Embodiment 184. The method of Embodiment 183, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

Embodiment 185. The method of Embodiment 184, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

Embodiment 186. The method of any one of Embodiments 183 to 185, wherein the modified corn plant exhibit an ear trait selected from the group consisting of increased ear area, increased ear volume, increased single kernel weight, increased ear fresh weight, increased ear diameter, increased ear length, increased yield, increased kernels per ear, decreased ear tip void, decreased ear void, and a combination thereof, relative to a control corn plant.

Embodiment 187. The method of any one of Embodiments 183 to 186, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

Embodiment 188. A modified corn plant comprising 1) one or more mutations or edits at or near one or more endogenous GA20 oxidase and/or GA3 oxidase genes, wherein the expression or activity of the one or more endogenous GA20 oxidase and/or GA3 oxidase genes is reduced relative to a wildtype control plant, 2) a first recombinant expression cassette comprising a coding sequence for a CO or COL polypeptide operably linked to a first plant-expressible promoter, and 3) a second recombinant expression cassette comprising a coding sequence for a MADS-box polypeptide operably linked to a second plant-expressible promoter.

Embodiment 189. The modified corn plant of Embodiment 188, wherein the modified corn plant is semi-dwarf and has one or more improved ear traits, relative to a control corn plant that does not comprise the one or more mutations or edits and the first and second recombinant expression cassettes.

Embodiment 190. The modified corn plant of Embodiment 188 or 189, wherein the one or more mutations or edits are selected from the group consisting of an insertion, a substitution, an inversion, a deletion, a duplication, and a combination thereof.

Embodiment 191. The modified corn plant of any one of Embodiments 188 to 190, wherein the one or more mutations or edits are introduced using a meganuclease, a zinc-finger nuclease (ZFN), a RNA-guided endonuclease, a TALE-endonuclease (TALEN), a recombinase, or a transposase.

Embodiment 192. The modified corn plant of any one of Embodiments 188 to 191, wherein the CO or COL polypeptide comprises a *Physcomitrella patens* CONSTANS-like 1 (PpCOL1) polypeptide.

Embodiment 193. The modified corn plant of Embodiment 192, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 194. The modified corn plant of Embodiment 192, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 195. The modified corn plant of any one of Embodiments 188 to 191, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 196. The modified corn plant of any one of Embodiments 188 to 191, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 197. The modified corn plant of any one of Embodiments 188 to 196, wherein the MADS-box polypeptide comprises a maize ZMM19 polypeptide.

Embodiment 198. The modified corn plant of Embodiment 197, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 199. The modified corn plant of Embodiment 197, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 200. The modified corn plant of any one of Embodiments 188 to 196, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 201. The modified corn plant of any one of Embodiments 188 to 200, wherein the first and second recombinant expression cassettes is stably integrated into the genome of the modified corn plant.

Embodiment 202. The modified corn plant of any one of Embodiments 188 to 201, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

Embodiment 203. The modified corn plant of any one of Embodiments 188 to 202, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

Embodiment 204. The modified corn plant of any one of Embodiments 188 to 203, wherein the modified corn plant exhibits improved lodging resistance, reduced green snap, or both, relative to the control corn plant.

Embodiment 205. The modified corn plant of any one of Embodiments 188 to 204, wherein the modified corn plant exhibits an ear trait selected from the group consisting of increased ear area, increased ear volume, increased single kernel weight, increased ear fresh weight, increased ear diameter, increased ear length, increased yield, increased kernels per ear, decreased ear tip void, decreased ear void, and a combination thereof, relative to a control corn plant.

Embodiment 206. The modified corn plant of any one of Embodiments 188 to 205, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

Embodiment 207. The modified corn plant of any one of Embodiments 188 to 206, wherein the modified corn plant does not have any significant off-types in at least one female organ or ear.

Embodiment 208. A plurality of modified corn plants in a field, each modified corn plant comprising a. one or more mutations or edits at or near one or more endogenous GA20 oxidase and/or GA3 oxidase genes, wherein the expression of the one or more endogenous GA20 oxidase and/or GA3 oxidase genes are reduced relative to a wildtype control plant, b. a first recombinant expression cassette comprising a coding sequence for a CO or COL polypeptide operably linked to a first plant-expressible promoter, and c. a second recombinant expression cassette comprising a coding sequence for a MADS-box polypeptide operably linked to a second plant-expressible promoter.

Embodiment 209. The plurality of modified corn plants of Embodiment 208, wherein the modified corn plants have increased yield relative to control corn plants.

Embodiment 210. The plurality of modified corn plants of Embodiment 208 or 209, wherein the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

Embodiment 211. A recombinant DNA construct comprising 1) a first expression cassette comprising a transcribable DNA sequence encoding a non-coding RNA for suppression of one or more GA20 oxidase or one or more GA3 oxidase genes, wherein the transcribable DNA sequence is operably linked to a first plant-expressible promoter, 2) a second expression cassette comprising a coding sequence for a CO or COL polypeptide operably linked to a second plant-expressible promoter, and 3) a third recombinant expression cassette comprising a coding sequence for a MADS-box polypeptide operably linked to a third plant-expressible promoter.

Embodiment 212. The recombinant DNA construct of Embodiment 211, wherein the first, second, and third expression cassettes are in a single T-DNA segment of a transformation vector.

Embodiment 213. The recombinant DNA construct of Embodiment 211, wherein the first, second, and third expression cassettes are in two different T-DNA segments of a transformation vector.

Embodiment 214. The recombinant DNA construct of any one of Embodiments 211 to 213, wherein the transcribable DNA sequence encodes a non-coding RNA for suppression of a GA3 oxidase gene.

Embodiment 215. The recombinant DNA construct of Embodiment 214, wherein the transcribable DNA sequence encodes a non-coding RNA for suppression of a GA3 oxidase_1 gene, a GA3 oxidase_2 gene, or both.

Embodiment 216. The recombinant DNA construct of Embodiment 215, wherein the transcribable DNA sequence comprises a sequence that is at least 80%, at least 85%, at least 90%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37.

Embodiment 217. The recombinant DNA construct of Embodiment 215, wherein the transcribable DNA sequence encodes a non-coding RNA comprising a sequence that is 80% complementary to at least 15 consecutive nucleotides of one or more of SEQ ID NOs: 28, 29, 31, 32, 36, and 37.

Embodiment 218. The recombinant DNA construct of Embodiment 214, wherein the transcribable DNA sequence encodes a non-coding RNA for suppression of a GA20 oxidase gene.

Embodiment 219. The recombinant DNA construct of Embodiment 218, wherein the transcribable DNA sequence encodes a non-coding RNA for suppression of a GA20 oxidase_3 gene, a GA20 oxidase_4 gene, a GA20 oxidase_5 gene, or a combination thereof.

Embodiment 220. The recombinant DNA construct of Embodiment 218, wherein the transcribable DNA sequence encodes a non-coding RNA for suppression of a GA20 oxidase_3 gene, a GA20 oxidase_5 gene, or both.

Embodiment 221. The recombinant DNA construct of Embodiment 220, wherein the transcribable DNA sequence comprises a sequence that is at least 80% identical or complementary to at least 15 consecutive nucleotides of SEQ ID NO: 39, 53, or 55.

Embodiment 222. The recombinant DNA construct of Embodiment 221, wherein the transcribable DNA sequence encodes a sequence that is at least 80% identical or complementary to at least 15 consecutive nucleotides of SEQ ID NO: 40, 54, or 56.

Embodiment 223. The recombinant DNA construct of any one of Embodiments 211 to 222, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, or 15.

Embodiment 224. The recombinant DNA construct of any one of Embodiments 211 to 222, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 30 or 33.

Embodiment 225. The recombinant DNA construct of any one of Embodiments to 211 to 223, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, or 14.

Embodiment 226. The recombinant DNA construct of any one of Embodiments to 211 to 223, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 28, 29, 31, or 32.

Embodiment 227. The recombinant DNA construct of any one of Embodiments 211 to 226, wherein the coding sequence for the CO or COL polypeptide encodes a *Physcomitrella patens* CONSTANS-like 1 (PpCOL1) polypeptide.

Embodiment 228. The recombinant DNA construct of Embodiment 227, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 229. The recombinant DNA construct of Embodiment 227, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 230. The recombinant DNA construct of any one of Embodiments 211 to 226, wherein the coding sequence for the CO or COL polypeptide comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 231. The recombinant DNA construct of any one of Embodiments 211 to 226, wherein the coding sequence for the CO or COL polypeptide comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 232. The recombinant DNA construct of any one of Embodiments 211 to 231, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 233. The recombinant DNA construct of Embodiment 232, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 234. The recombinant DNA construct of any one of Embodiments 211 to 231, wherein the coding sequence for the MADS-box polypeptide comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 235. The recombinant DNA construct of any one of Embodiments 211 to 234, the first, second, and/or third plant-expressible promoter is a vascular promoter.

Embodiment 236. The recombinant DNA construct of Embodiment 235, wherein the vascular promoter is selected from the group consisting of a sucrose synthase promoter, a sucrose transporter promoter, a Sh1 promoter, CoYMV promoter, a WDV large intergenic region (LIR) promoter, a MSV coat polypeptide (CP) promoter, a rice yellow stripe 1 (YS1)-like promoter, a rice yellow stripe 2 (OsYSL2) promoter, and a combination thereof.

Embodiment 237. The recombinant DNA construct of any one of Embodiments 211 to 234, wherein the first plant-expressible promoter is an RTBV promoter.

Embodiment 238. The recombinant DNA construct of any one of Embodiments 211 to 234, wherein the first or second plant-expressible promoter is a leaf promoter.

Embodiment 239. The recombinant DNA construct of Embodiment 238, wherein the leaf promoter is selected from the group consisting of a RuBisCO promoter, a PPDK promoter, a FDA promoter, a Nadh-Gogat promoter, a chlorophyll a/b binding polypeptide gene promoter, a PEPC promoter, a Myb gene promoter, and a combination thereof.

Embodiment 240. The recombinant DNA construct of any one of Embodiments 211 to 234, wherein the first, second, and/or third plant-expressible promoter is a constitutive promoter.

Embodiment 241. The recombinant DNA construct of Embodiment 240, wherein the constitutive promoter is selected from the group consisting of an actin promoter, a CaMV 35S or 19S promoter, a plant ubiquitin promoter, a plant Gos2 promoter, a FMV promoter, a CMV promoter, a MMV promoter, a PCLSV promoter, an Emu promoter, a tubulin promoter, a nopaline synthase promoter, an octopine synthase promoter, a mannopine synthase promoter, or a maize alcohol dehydrogenase, a functional portion thereof, and a combination thereof.

Embodiment 242. The recombinant DNA construct of any one of Embodiments 211 to 234, wherein the third plant-expressible promoter is a root promoter.

Embodiment 243. The recombinant DNA construct of Embodiment 242, wherein the root promoter comprises a DNA sequence that is at least 80%, at least 85%, at least 90%, at least 95%, at least 96%, at least 97%, at least 98%, at least 99%, at least 99.5%, or 100% identical to SEQ ID NO: 178 or a functional portion thereof.

Embodiment 244. The recombinant DNA construct of any one of Embodiments 211 to 234, wherein the second and/or third plant-expressible promoter is a meristem promoter.

Embodiment 245. The recombinant DNA construct of Embodiment 244, wherein the meristem promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or both of SEQ ID NOs: 484 and 485, or a functional portion therof.

Embodiment 246. The recombinant DNA construct of any one of Embodiments 211 to 234, wherein the second and/or third plant-expressible promoter is a seed promoter or a kernel promoter.

Embodiment 247. The recombinant DNA construct of Embodiment 246, wherein the seed promoter or the kernel promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 486-491, or a functional portion thereof.

Embodiment 248. The recombinant DNA construct of any one of Embodiments 211 to 234, wherein the first plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 172 or a functional portion thereof.

Embodiment 249. The recombinant DNA construct of any one of Embodiments 211 to 231, wherein the second plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 178 or a functional portion therof.

Embodiment 250. The recombinant DNA construct of any one of Embodiments 211 to 249, wherein the non-coding RNA is a precursor miRNA or siRNA capable of being processed or cleaved to form a mature miRNA or siRNA.

Embodiment 251. A transformation vector comprising the recombinant DNA construct of any one of Embodiments 211 to 250.

Embodiment 252. A modified corn plant or a plant part thereof comprising the recombinant DNA construct of Embodiment 251.

Embodiment 253. The modified corn plant of Embodiment 252, wherein the modified corn plant is semi-dwarf and has one or more improved ear traits, relative to a control corn plant not having the first, second, and third expression cassettes.

Embodiment 254. The modified corn plant of Embodiment 252 or 253, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

Embodiment 255. The modified corn plant of any one of Embodiments 252 to 254, wherein the modified corn plant exhibits improved lodging resistance, reduced green snap, or both, relative to the control corn plant.

Embodiment 256. The modified corn plant of any one of Embodiments 252 to 255, wherein the modified corn plant exhibits an ear trait selected from the group consisting of increased ear area, increased ear volume, increased single kernel weight, increased ear fresh weight, increased ear diameter, increased ear length, increased yield, increased kernels per ear, decreased ear tip void, decreased ear void, and a combination thereof, relative to a control corn plant.

Embodiment 257. The modified corn plant of any one of Embodiments 252 to 256, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to the control corn plant.

Embodiment 258. The modified corn plant of any one of Embodiments 252 to 257, wherein the modified corn plant does not have any significant off-types in at least one female organ or ear.

Embodiment 259. A modified corn plant or a plant part thereof comprising 1) a first recombinant expression cassette comprising a first DNA sequence encoding a CONSTANS (CO) or CONSTANS-like (COL) polypeptide, and 2) a second recombinant expression cassette comprising a second DNA sequence encoding a MADS-box polypeptide.

Embodiment 260. The modified corn plant or plant part thereof of Embodiment 259, wherein the CO or COL polypeptide comprises a *Physcomitrella patens* CONSTANS-like 1 (PpCOL1) polypeptide.

Embodiment 261. The modified corn plant or plant part thereof of Embodiment 259, wherein the first DNA sequence of the second recombinant expression cassette comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 262. The modified corn plant or plant part thereof of Embodiment 259, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 263. The modified corn plant or plant part thereof of Embodiment 259, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ Embodiment 264. The modified corn plant or plant part thereof of Embodiment 259, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 265. The modified corn plant or plant part thereof of any one of Embodiments 259 to 264, wherein the MADS-box polypeptide comprises a maize ZMM19 polypeptide.

Embodiment 266. The modified corn plant or plant part thereof of any one of Embodiments 259 to 264, wherein the second DNA sequence of the second recombinant expression cassette comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 267. The modified corn plant or plant part thereof of any one of Embodiments 259 to 264, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NO: 176.

Embodiment 268. The modified corn plant or plant part thereof of any one of Embodiments 259 to 264, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 269. The modified corn plant or plant part thereof of any one of Embodiments 259 to 268, wherein the first DNA sequence is linked to a first heterologous plant-expressible promoter and the second DNA sequence is operably linked to a second heterologous plant-expressible promoter.

Embodiment 270. The modified corn plant or plant part thereof of Embodiment 269, wherein the first or second heterologous plant-expressible promoter is a constitutive promoter.

Embodiment 271. The modified corn plant or plant part thereof of Embodiment 270, wherein the constitutive promoter is selected from the group consisting of an actin promoter, a Cauliflower mosaic virus (CaMV) 35S or 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, or a maize alcohol dehydrogenase, a functional portion thereof, and a combination thereof.

Embodiment 272. The modified corn plant or plant part thereof of Embodiment 269, wherein the first heterologous plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 172 or a functional portion thereof.

Embodiment 273. The modified corn plant or plant part thereof of Embodiment 269, wherein the second heterologous plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 178 or a functional portion thereof.

Embodiment 274. The modified corn plant or plant part thereof of Embodiment 269, wherein the first or second heterologous plant-expressible promoter is a vascular promoter.

Embodiment 275. The modified corn plant or plant part thereof of Embodiment 274, wherein the vascular promoter is selected from the group consisting of a sucrose synthase promoter, a sucrose transporter promoter, a Sh1 promoter, Commelina yellow mottle virus (CoYMV) promoter, a wheat dwarf geminivirus (WDV) large intergenic region (LIR) promoter, a maize streak geminivirus (MSV) coat polypeptide (CP) promoter, a rice yellow stripe 1 (YS1)-like promoter, a rice yellow stripe 2 (OsYSL2) promoter, and a combination therof.

Embodiment 276. The modified corn plant or plant part thereof of Embodiment 274, wherein the vascular promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 67, SEQ ID NO: 68, SEQ ID NO: 69, SEQ ID NO: 70 or SEQ ID NO: 71, or a functional portion thereof.

Embodiment 277. The modified corn plant or plant part thereof of Embodiment 269, wherein the second heterologous plant-expressible promoter is a root promoter.

Embodiment 278. The modified corn plant or plant part thereof of Embodiment 277, wherein the root promoter comprises a DNA sequence that is at least 80%, at least 85%, at least 90%, at least 95%, at least 96%, at least 97%, at least 98%, at least 99%, at least 99.5%, or 100% identical to SEQ ID NO: 178 or a functional portion thereof.

Embodiment 279. The modified corn plant or plant part thereof of Embodiment 269, wherein the first heterologous plant-expressible promoter is a leaf promoter.

Embodiment 280. The modified corn plant or plant part thereof of Embodiment 279, wherein the leaf promoter is selected from the group consisting of a RuBisCO promoter, a pyruvate phosphate dikinase (PPDK) promoter, a fructose 1-6 bisphosphate aldolase (FDA) promoter, a Nadh-Gogat promoter, a chlorophyll a/b binding polypeptide gene promoter, a phosphoenolpyruvate carboxylase (PEPC) promoter, a Myb gene promoter, and a combination thereof.

Embodiment 281. The modified corn plant or plant part thereof of Embodiment 279, wherein the leaf promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 72, SEQ ID NO: 73 or SEQ ID NO: 74, or a functional portion therof.

Embodiment 282. The modified corn plant or plant part thereof of Embodiment 269, wherein the first or second heterologous plant-expressible promoter is a meristem promoter.

Embodiment 283. The modified corn plant or plant part thereof of Embodiment 282, wherein the meristem promoter is a meristem-preferred promoter or a meristem-specific promoter.

Embodiment 284. The modified corn plant or plant part thereof of Embodiment 282 or 283, wherein the meristem promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or both of SEQ ID NOs: 484 and 485, or a functional portion thereof.

Embodiment 285. The modified corn plant or plant part thereof of Embodiment 269, wherein the first or second heterologous plant-expressible promoter is a seed promoter or a kernel promoter.

Embodiment 286. The modified corn plant or plant part thereof of Embodiment 285, wherein the seed promoter or kernel promoter is a seed-preferred promoter or a kernel-preferred promoter.

Embodiment 287. The modified corn plant or plant part thereof of Embodiment 285, wherein the seed promoter or kernel promoter is a seed-specific promoter or a kernel-specific promoter.

Embodiment 288. The modified corn plant or plant part thereof of Embodiment 285, 286 or 287, wherein the seed promoter or the kernel promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 486-491, or a functional portion thereof.

Embodiment 289. The modified corn plant or plant part thereof of any one of Embodiments 259 to 288, wherein the modified corn plant exhibits increased ear area relative to a control corn plant.

Embodiment 290. The modified corn plant or plant part thereof of any one of Embodiments 259 to 289, wherein the modified corn plant exhibits an increase in ear area by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to a control corn plant.

Embodiment 291. The modified corn plant or plant part thereof of any one of Embodiments 259 to 290, wherein the modified corn plant exhibits increased single kernel weight relative to a control corn plant.

Embodiment 292. The modified corn plant or plant part thereof of any one of Embodiments 259 to 291, wherein the modified corn plant exhibits an increase in singe kernel weight by at least at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to a control corn plant.

Embodiment 293. The modified corn plant or plant part thereof of any one of Embodiments 259 to 292, wherein the modified corn plant exhibits increased ear fresh weight relative to a control corn plant.

Embodiment 294. The modified corn plant or plant part thereof of any one of Embodiments 259 to 293, wherein the modified corn plant exhibits increased ear fresh weight by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to a control corn plant.

Embodiment 295. The modified corn plant or plant part thereof of any one of Embodiments 259 to 294, wherein the modified corn plant exhibits increased ear diameter relative to a control corn plant.

Embodiment 296. The modified corn plant or plant part thereof of any one of Embodiments 259 to 295, wherein the modified corn plant exhibits increased ear diameter by at least 0.2%, at least 0.4%, at least 0.6%, at least 0.8%, at least 1.0%, at least 1.2%, at least 1.4%, at least 1.6%, at least 1.8%, at least 2.0%, at least 2.2%, at least 2.4%, at least 2.6%, at least 2.8%, at least 3.0%, at least 3.2%, at least 3.4%, at least 3.6%, at least 3.8%, or at least 4.0%, relative to the control corn plant.

Embodiment 297. The modified corn plant or plant part thereof of any one of Embodiments 259 to 296, wherein the modified corn plant exhibits increased ear length relative to a control corn plant.

Embodiment 298. The modified corn plant or plant part thereof of any one of Embodiments 259 to 297, wherein the modified corn plant exhibits an increased ear length by at least 1%, at least 2%, at least 3%, at least 4%, at least 5%, at least 6%, at least 7%, at least 8%, at least 9%, at least 10%, at least 11%, at least 12%, at least 13%, at least 14%, or at least 15%, at least 16%, at least 17%, at least 18%, at least 19%, or at least 20%, relative to the control corn plant.

Embodiment 299. The modified corn plant or plant part thereof of any one of Embodiments 259 to 298, wherein the modified corn plant exhibits increased ear volume relative to a control corn plant.

Embodiment 300. The modified corn plant or plant part thereof of Embodiment 299, wherein the modified corn plant exhibits an increase in ear volume by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to the control corn plant.

Embodiment 301. The modified corn plant or plant part thereof of any one of Embodiments 259 to 300, wherein the modified corn plant exhibits increased yield relative to a control corn plant.

Embodiment 302. The modified corn plant or plant part thereof of Embodiment 301, wherein the modified corn plant exhibits an increase in yield by at least 1%, at least 3%, at least 5%, at least 7%, at least 9%, at least 11%, at least 13%, at least 15%, at least 17%, at least 19%, at least 21%, at least 23%, at least 25%, at least 27%, at least 29%, at least 31%, at least 33%, at least 35%, at least 37%, at least 39%, at least 41%, at least 43%, or at least 45%, relative to the control corn plant.

Embodiment 303. The modified corn plant or plant part thereof of any one of Embodiments 259 to 302, wherein the modified corn plant exhibits increased number of kernels per ear relative to a control corn plant.

Embodiment 304. The modified corn plant or plant part thereof of Embodiment 303, wherein the modified corn plant exhibits an increase in number of kernels per ear by at least 1%, at least 2%, at least 3%, at least 4%, at least 5%, at least 6%, at least 7%, at least 8%, at least 9%, at least 10%, at least 11%, at least 12%, at least 13%, at least 14%, or at least 15%, at least 16%, at least 17%, at least 18%, at least 19%, or at least 20%, relative to the control corn plant.

Embodiment 305. The modified corn plant or plant part thereof of any one of Embodiments 259 to 304, wherein the modified corn plant exhibits decreased ear tip void relative to a control corn plant.

Embodiment 306. The modified corn plant or plant part thereof of Embodiment 305, wherein the modified corn plant exhibits a decrease in ear tip void by at least 1%, at least 2%, at least 3%, at least 4%, at least 5%, at least 6%, at least 7%, at least 8%, at least 9%, at least 10%, at least 11%, at least 12%, at least 13%, at least 14%, or at least 15%, at least 16%, at least 17%, at least 18%, at least 19%, or at least 20%, relative to the control corn plant.

Embodiment 307. The modified corn plant or plant part thereof of any one of Embodiments 259 to 306, wherein the modified corn plant exhibits decreased ear void relative to a control corn plant.

Embodiment 308. The modified corn plant or plant part thereof of Embodiment 307, wherein the modified corn plant exhibits a decrease in ear void by at least 1%, at least 2%, at least 3%, at least 4%, at least 5%, at least 6%, at least 7%, at least 8%, at least 9%, at least 10%, at least 11%, at least 12%, at least 13%, at least 14%, or at least 15%, at least 16%, at least 17%, at least 18%, at least 19%, or at least 20%, relative to the control corn plant.

Embodiment 309. A seed of the modified corn plant of any one of Embodiments 259 to 308, wherein the seed comprises the first and second recombinant expression cassettes.

Embodiment 310. The seed of Embodiment 309, wherein a progeny plant grown from the seed has one or more improved ear traits, relative to a control corn plant that does not contain both the first and the second recombinant expression cassette.

Embodiment 311. A commodity or commodity product produced from the seed of Embodiment 310, comprising the first and second recombinant expression cassettes.

Embodiment 312. A method comprising planting the seed of Embodiment 309 in a growth medium or soil.

Embodiment 313. The method of Embodiment 312, further comprising planting a plurality of the seeds with a row spacing of less than or equal to 40 inches.

Embodiment 314. The method of Embodiment 312, further comprising planting a plurality of the seeds with a row spacing of less than or equal to 30 inches.

Embodiment 315. The method of Embodiment 314, wherein the row spacing is less than or equal to 20 inches.

Embodiment 316. The method of Embodiment 312, further comprising growing a corn plant from the seed.

Embodiment 317. The method of Embodiment 316, further comprising harvesting a seed from the corn plant.

Embodiment 318. The method of any one of Embodiments 312 to 317, wherein the seed is planted at a density selected from the group consisting of at least 38,000 plants per acre, at least 40,000 plants per acre, at least 42,000 plants per acre, at least 44,000 plants per acre, at least 45,000 plants per acre, at least 46,000 plants per acre, at least 48,000 plants per acre, 50,000 plants per acre, at least 52,000 plants per acre, at least 54,000 per acre, and at least 56,000 plants per acre.

Embodiment 319. A plurality of modified corn plants in a field, each modified corn plant comprising
  a. a first recombinant expression cassette comprising a first DNA sequence encoding a CO or COL polypeptide, and
  b. a second recombinant expression cassette comprising a second DNA sequence encoding a MADS-box polypeptide.

Embodiment 320. The plurality of modified corn plants of Embodiment 319, wherein the modified corn plants have increased yield relative to control corn plants.

Embodiment 321. The plurality of modified corn plants of Embodiment 319 or 320, wherein the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

Embodiment 322. A method for producing a modified corn plant, the method comprising:
- a. introducing into a corn cell a first recombinant expression cassette comprising a coding sequence for a CO or COL polypeptide, wherein the corn cell comprises a second recombinant expression cassette comprising a coding sequence for a MADS-box polypeptide; and
- b. regenerating or developing a modified corn plant from the corn cell, wherein the modified corn plant comprises the first and second recombinant expression cassettes.

Embodiment 323. A method for producing a modified corn plant, the method comprising:
- a. introducing into a corn cell a first recombinant expression cassette comprising a coding sequence for a MADS-box polypeptide, wherein the corn cell comprises a second recombinant expression cassette comprising a coding sequence for a CO or COL polypeptide; and
- b. regenerating or developing a modified corn plant from the corn cell, wherein the modified corn plant comprises the first and second recombinant expression cassettes.

Embodiment 324. A method for producing a modified corn plant, the method comprising:
- a. introducing into a corn cell 1) a first recombinant expression cassette comprising a coding sequence for a CO or COL polypeptide, and 2) a second recombinant expression cassette comprising a coding sequence for a MADS-box polypeptide; and
- b. regenerating or developing a modified corn plant from the corn cell, wherein the modified corn plant comprises the first and second recombinant expression cassettes.

Embodiment 325. The method of Embodiment 324, wherein the introducing is via site-directed integration using a site-specific nuclease.

Embodiment 326. The method of Embodiment 325, wherein the site-specific nuclease is selected from the group consisting of a RNA-guided endonuclease, a meganuclease, a zinc-finger nuclease (ZFN), a TALE-endonuclease (TALEN), a recombinase, and a transposase.

Embodiment 327. The method of Embodiment 324, wherein the introducing is via *Agrobacterium*-mediated transformation.

Embodiment 328. The method of Embodiment 324, wherein the introducing is via particle bombardment.

Embodiment 329. The method of any one of Embodiments 322 to 328, wherein the CO or COL polypeptide comprises a *Physcomitrella patens* CONSTANS-like 1 (PpCOL1) polypeptide.

Embodiment 330. The method of any one of Embodiments 322 to 328, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 331. The method of any one of Embodiments 322 to 328, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 332. The method of any one of Embodiments 322 to 328, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 333. The method of any one of Embodiments 322 to 328, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 334. The method of any one of Embodiments 322 to 333, wherein the MADS-box polypeptide comprises a maize ZMM19 polypeptide.

Embodiment 335. The method of any one of Embodiments 322 to 333, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 336. The method of any one of Embodiments 322 to 333, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 337. The method of any one of Embodiments 322 to 333, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 338. The method of any one of Embodiments 322 to 337, wherein the first and second recombinant expression cassettes are stably integrated into the genome of the corn cell.

Embodiment 339. The method of any one of Embodiments 322 to 338, further comprising selecting a modified corn plant having a desired trait.

Embodiment 340. The method of Embodiment 339, wherein the selecting a modified corn plant having a desired trait comprises the use of one or more molecular techniques.

Embodiment 341. The method of Embodiment 340, wherein the one or more molecular techniques are selected from the group consisting of Southern analysis, polymerase chain reaction (PCR) amplification, Northern blots, RNase protection, primer extension, reverse transcription PCR (RT-PCR), Sanger sequencing, Next Generation sequencing technologies, enzymatic assays, protein gel electrophoresis, Western blots, immunoprecipitation, enzyme-linked immunoassays, in situ hybridization, enzyme staining, immunostaining, marker genotyping, and a combination thereof.

Embodiment 342. The method of any one of Embodiments 322 to 341, wherein the modified corn plant exhibits an ear trait selected from the group consisting of increased ear area, increased ear volume, increased single kernel weight, increased ear fresh weight, increased ear diameter, increased ear length, increased yield, increased kernels per ear, decreased ear tip void, decreased ear void, and a combination thereof, relative to a control corn plant.

Embodiment 343. A method for producing a modified corn plant, the method comprising:
  a. crossing a first modified corn plant with a second modified corn plant, wherein the first modified corn plant comprises a first recombinant expression cassette comprising a coding sequence for a CO or COL polypeptide, and wherein the second modified corn plant comprises a second recombinant expression cassette comprising a coding sequence for a MADS-box polypeptide; and
  b. producing a progeny corn plant comprising the first and second recombinant expression cassettes.

Embodiment 344. The method of any one of Embodiments 343, wherein the first and/or second modified corn plant(s) are obtained via site-directed integration using a site-specific nuclease.

Embodiment 345. The method of Embodiment 344, wherein the site-specific nuclease is selected from the group consisting of a RNA-guided endonuclease, a meganuclease, a zinc-finger nuclease (ZFN), a TALE-endonuclease (TALEN), a recombinase, and a transposase.

Embodiment 346. The method of any one of Embodiments 343, wherein the first and/or second modified corn plant(s) are obtained via *Agrobacterium*-mediated transformation.

Embodiment 347. The method of any one of Embodiments 343, wherein the first and/or second modified corn plant(s) are obtained via particle bombardment.

Embodiment 348. The method of any one of Embodiments 343 to 347, wherein the CO or COL polypeptide comprises a *Physcomitrella patens* CONSTANS-like 1 (PpCOL1) polypeptide.

Embodiment 349. The method of any one of Embodiments 343 to 347, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 350. The method of any one of Embodiments 343 to 347, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 351. The method of any one of Embodiments 343 to 347, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 352. The method of any one of Embodiments 343 to 347, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 353. The method of any one of Embodiments 343 to 352, wherein the MADS-box polypeptide comprises a maize ZMM19 polypeptide.

Embodiment 354. The method of any one of Embodiments 343 to 352, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 355. The method of any one of Embodiments 343 to 352, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 356. The method of any one of Embodiments 343 to 352, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 357. The method of any one of Embodiments 343 to 356, further comprising selecting a progeny corn plant having a desired trait.

Embodiment 358. The method of Embodiment 357, wherein the selected progeny corn plant has one or more improved ear traits, relative to a control corn plant.

Embodiment 359. The method of Embodiment 357 or 358, wherein the selecting a progeny corn plant having a desired trait comprises the use of one or more molecular techniques.

Embodiment 360. The method of Embodiment 359, wherein the one or more molecular techniques are selected from the group consisting of Southern analysis, PCR amplification, Northern blots, RNase protection, primer extension, RT-PCR, Sanger sequencing, Next Generation sequencing technologies, enzymatic assays, protein gel electrophoresis, Western blots, immunoprecipitation, enzyme-linked immunoassays, in situ hybridization, enzyme staining, immunostaining, marker genotyping, and a combination thereof.

Embodiment 361. The method of any one of Embodiments 343 to 360, wherein the progeny corn plant exhibit an ear trait selected from the group consisting of increased ear area, increased ear volume, increased single kernel weight, increased ear fresh weight, increased ear diameter, increased ear length, increased yield, increased kernels per ear, decreased ear tip void, decreased ear void, and a combination thereof, relative to a control corn plant.

Embodiment 362. The method of any one of Embodiments 343 to 361, wherein the progeny corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

Embodiment 363. A method for producing a modified corn plant, the method comprising:
a. introducing into a corn cell a first recombinant expression cassette comprising a coding sequence for a CO or COL polypeptide operably linked to a first plant-expressible promoter, and wherein the corn cell comprises a second recombinant expression cassette comprising a coding sequence for a MADS-box polypeptide operably linked to a second plant-expressible promoter; and
b. regenerating or developing a modified corn plant from the corn cell, wherein the modified corn plant comprises the first and second recombinant expression cassettes.

Embodiment 364. A method for producing a modified corn plant, the method comprising:
a. introducing into a corn cell a first recombinant expression cassette comprising a coding sequence for a MADS-box polypeptide operably linked to a first plant-expressible promoter, and wherein the corn cell comprises a second recombinant expression cassette comprising a coding sequence for a CO or COL polypeptide operably linked to a second plant-expressible promoter; and
b. regenerating or developing a modified corn plant from the corn cell, wherein the modified corn plant comprises the first and second recombinant expression cassettes.

Embodiment 365. The method of Embodiment 363 or 364, wherein the introducing is via site-directed integration using a site-specific nuclease, *Agrobacterium*-mediated transformation or particle bombardment.

Embodiment 366. The method of any one of Embodiments 363 to 365, wherein the CO or COL polypeptide comprises a *Physcomitrella patens* CONSTANS-like 1 (PpCOL1) polypeptide.

Embodiment 367. The method of any one of Embodiments 363 to 365, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 368. The method of any one of Embodiments 363 to 365, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 369. The method of any one of Embodiments 363 to 365, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 370. The method of any one of Embodiments 363 to 365, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 371. The method of any one of Embodiments 363 to 370, wherein the MADS-box polypeptide comprises a maize ZMM19 polypeptide Embodiment 372. The method of any one of Embodiments 363 to 370, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 373. The method of any one of Embodiments 363 to 370, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 374. The method of any one of Embodiments 363 to 373, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 375. The method of any one of Embodiments 363 to 374, further comprising selecting a modified corn plant having a desired trait.

Embodiment 376. The method of any one of Embodiments 363 to 374, wherein the modified corn plant exhibits an ear trait selected from the group consisting of increased ear area, increased ear volume, increased single kernel weight, increased ear fresh weight, increased ear diameter, increased ear length, increased yield, increased kernels per ear, decreased ear tip void, decreased ear void, and a combination thereof, relative to a control corn plant.

Embodiment 377. The method of any one of Embodiments 363 to 376, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

Embodiment 378. A modified corn plant comprising a first recombinant expression cassette comprising a coding sequence for a CO or COL polypeptide operably linked to a first plant-expressible promoter, and a second recombinant expression cassette comprising a coding sequence for a MADS-box polypeptide operably linked to a second plant-expressible promoter.

Embodiment 379. The modified corn plant of Embodiment 378, wherein the CO or COL polypeptide comprises a *Physcomitrella patens* CONSTANS-like 1 (Pp-COL1) polypeptide.

Embodiment 380. The modified corn plant of Embodiment 378, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 381. The modified corn plant of Embodiment 378, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 382. The modified corn plant of Embodiment 378, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 383. The modified corn plant of Embodiment 378, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 384. The modified corn plant of any one of Embodiments 378 to 383, wherein the MADS-box polypeptide comprises a maize ZMM19 polypeptide.

Embodiment 385. The modified corn plant of any one of Embodiments 378 to 383, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 386. The modified corn plant of any one of Embodiments 378 to 383, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 387. The modified corn plant of any one of Embodiments 378 to 383, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 388. The modified corn plant of any one of Embodiments 378 to 387, wherein the first and second recombinant expression cassettes is stably integrated into the genome of the modified corn plant.

Embodiment 389. The modified corn plant of any one of Embodiments 378 to 388, wherein the modified corn plant exhibits an ear trait selected from the group consisting of increased ear area, increased ear volume, increased single kernel weight, increased ear fresh weight, increased ear diameter, increased ear length, increased yield, increased kernels per ear, decreased ear tip void, decreased ear void, and a combination thereof, relative to a control corn plant.

Embodiment 390. The modified corn plant of any one of Embodiments 378 to 389, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

Embodiment 391. The modified corn plant of any one of Embodiments 378 to 390, wherein the modified corn plant does not have any significant off-types in at least one female organ or ear.

Embodiment 392. A plurality of modified corn plants in a field, each modified corn plant comprising
  a. a first recombinant expression cassette comprising a coding sequence for a CO or COL polypeptide operably linked to a first plant-expressible promoter, and
  b. a second recombinant expression cassette comprising a coding sequence for a MADS-box polypeptide operably linked to a second plant-expressible promoter.

Embodiment 393. The plurality of modified corn plants of Embodiment 392, wherein the modified corn plants have increased yield relative to control corn plants.

Embodiment 394. The plurality of modified corn plants of Embodiment 392 or 393, wherein the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

Embodiment 395. A recombinant DNA construct comprising a first expression cassette comprising a coding sequence for a CO or COL polypeptide operably linked to a first plant-expressible promoter, and a second recombinant expression cassette comprising a coding sequence for a MADS-box polypeptide operably linked to a second plant-expressible promoter.

Embodiment 396. The recombinant DNA construct of Embodiment 395, wherein the first and second expression cassettes are in a single T-DNA segment of a transformation vector.

Embodiment 397. The recombinant DNA construct of Embodiment 395, wherein the first and second expression cassettes are in two different T-DNA segments of a transformation vector.

Embodiment 398. The recombinant DNA construct of any one of Embodiments 395 to 397, wherein the coding sequence for the CO or COL polypeptide encodes a *Physcomitrella patens* CONSTANS-like 1 (PpCOL1) polypeptide.

Embodiment 399. The recombinant DNA construct of any one of Embodiments 395 to 397, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

Embodiment 400. The recombinant DNA construct of any one of Embodiments 395 to 397, wherein the coding sequence for the CO or COL polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

Embodiment 401. The recombinant DNA construct of any one of Embodiments 395 to 397, wherein the coding sequence for the CO or COL polypeptide comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 182-403.

Embodiment 402. The recombinant DNA construct of any one of Embodiments 395 to 397, wherein the coding sequence for the CO or COL polypeptide comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 404-458.

Embodiment 403. The recombinant DNA construct of any one of Embodiments 395 to 402, wherein the MADS-box polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 176.

Embodiment 404. The recombinant DNA construct of any one of Embodiments 395 to 402, wherein the coding sequence for the MADS-box polypeptide comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 177.

Embodiment 405. The recombinant DNA construct of any one of Embodiments 395 to 402, wherein the coding sequence for the MADS-box polypeptide comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 459-483.

Embodiment 406. The recombinant DNA construct of any one of Embodiments 395 to 402, wherein the first and/or second plant-expressible promoter is a vascular promoter.

Embodiment 407. The recombinant DNA construct of Embodiment 406, wherein the vascular promoter is selected from the group consisting of a sucrose synthase promoter, a sucrose transporter promoter, a Sh1 promoter, CoYMV promoter, a WDV large intergenic region (LIR) promoter, a MSV coat polypeptide (CP) promoter, a rice yellow stripe 1 (YS1)-like promoter, a rice yellow stripe 2 (OsYSL2) promoter, and a combination thereof.

Embodiment 408. The recombinant DNA construct of Embodiment 406, wherein the first and/or second plant-expressible promoter is an RTBV promoter.

Embodiment 409. The recombinant DNA construct of any one of Embodiments 395 to 408, wherein the first and/or second plant-expressible promoter is a leaf promoter.

Embodiment 410. The recombinant DNA construct of Embodiment 409, wherein the leaf promoter is selected from the group consisting of a RuBisCO promoter, a PPDK promoter, a FDA promoter, a Nadh-Gogat promoter, a chlorophyll a/b binding polypeptide gene promoter, a PEPC promoter, a Myb gene promoter, and a combination thereof.

Embodiment 411. The recombinant DNA construct of any one of Embodiments 395 to 410, wherein the first and/or second plant-expressible promoter is a constitutive promoter.

Embodiment 412. The recombinant DNA construct of Embodiment 411, wherein the constitutive promoter is selected from the group consisting of an actin promoter, a CaMV 35S or 19S promoter, a plant ubiquitin promoter, a plant Gos2 promoter, a FMV promoter, a CMV promoter, a MMV promoter, a PCLSV promoter, an Emu promoter, a tubulin promoter, a nopaline synthase promoter, an octopine synthase promoter, a mannopine synthase promoter, or a maize alcohol dehydrogenase, a functional portion thereof, and a combination therof.

Embodiment 413. The recombinant DNA construct of any one of Embodiments 395 to 412, wherein the second plant-expressible promoter is a root promoter.

Embodiment 414. The recombinant DNA construct of Embodiment 413, wherein the root promoter comprises a DNA sequence that is at least 80%, at least 85%, at least 90%, at least 95%, at least 96%, at least 97%, at least 98%, at least 99%, at least 99.5%, or 100% identical to SEQ ID NO: 178 or a functional portion thereof.

Embodiment 415. The recombinant DNA construct of any one of Embodiments 395 to 414, wherein the first and/or second plant-expressible promoter is a meristem promoter.

Embodiment 416. The recombinant DNA construct of Embodiment 415, wherein the meristem promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or both of SEQ ID NOs: 484 and 485, or a functional portion thereof.

Embodiment 417. The recombinant DNA construct of any one of Embodiments 395 to 416, wherein the first and/or second plant-expressible promoter is a seed promoter or a kernel promoter.

Embodiment 418. The recombinant DNA construct of Embodiment 417, wherein the seed promoter or the kernel promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 486-491, or a functional portion thereof.

Embodiment 419. The recombinant DNA construct of any one of Embodiments 395 to 418, wherein the first plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 172 or a functional portion thereof.

Embodiment 420. The recombinant DNA construct of any one of Embodiments 395 to 419, wherein the second plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 178 or a functional portion thereof.

Embodiment 421. A transformation vector comprising the recombinant DNA construct of any one of Embodiments 395 to 420.

Embodiment 422. A modified corn plant or a plant part thereof comprising the recombinant DNA construct of any one of Embodiments 395 to 420.

Embodiment 423. The modified corn plant of Embodiment 422, wherein the modified corn plant exhibits an ear trait selected from the group consisting of increased ear area, increased ear volume, increased single kernel weight, increased ear fresh weight, increased ear diameter, increased ear length, increased yield, increased kernels per ear, decreased ear tip void, decreased ear void, and a combination thereof, relative to a control corn plant.

Embodiment 424. The modified corn plant of Embodiment 422 or 423, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to the control corn plant.

Embodiment 425. The modified corn plant of any one of Embodiments 422 to 424, wherein the modified corn plant does not have any significant off-types in at least one female organ or ear.

EXAMPLES

Example 1. Generation of the GA20Ox_SUP Plants and GA20Ox_SUP/PpCOL/ZMM19 Stack Plants An inbred corn plant line was transformed via *Agrobacterium*-mediated transformation with a transformation vector having a construct of an expression cassette comprising a miRNA-encoding DNA sequence (SEQ ID NO: 39) encoding a targeting sequence (SEQ ID NO: 40) under the control of a rice tungro bacilliform virus (RTBV) promoter (SEQ ID NO: 65) known to cause expression in vascular tissues of plants. The expression cassette is herein referred to as GA20Ox_SUP cassette. The miRNA encoded by the cassette comprises an RNA sequence that targets the GA20 oxidase_3 and GA20 oxidase_5 genes in corn plants for suppression. Several transformation events were generated therefrom. The transformed/transgenic inbred line can be crossed with a different inbred line that does not have the transgene to produce a GA20Ox_SUP or GA20Ox_SUP single hybrid line.

Similarly, an inbred corn plant line was transformed via *Agrobacterium*-mediated transformation with a transformation vector having a construct of three expression cassettes, one of which is the GA20Ox_SUP cassette. A second expression cassette, referred to herein as PpCOL cassette, comprises an *Oryza sativa* enhancer (SEQ ID NO: 170), a CaMV 35S enhancer (SEQ ID NO: 171), an *Oryza sativa* promoter (SEQ ID NO: 172), a leader sequence (SEQ ID NO: 173), an intron sequence (SEQ ID NO: 174), and a terminator sequence (SEQ ID NO: 175), operably linked to a polynucleotide sequence (SEQ ID NO: 169) encoding *Physcomitrella patens* CONSTANS-like 1 (PpCOL1) polypeptide (SEQ ID NO: 168). A third expression cassette, referred to herein as ZMM19 cassette, comprises an *Oryza sativa* Rcc3 gene promoter region (SEQ ID NO: 178), a leader sequence thereof (SEQ ID NO: 179), a *Zea mays* intron sequence (SEQ ID NO: 180), and an *Oryza sativa* UP2 terminator region (SEQ ID NO: 181), operably linked to a polynucleotide sequence (SEQ ID NO: 177) encoding maize ZMM19 polypeptide (SEQ ID NO: 176). Several transformation events were generated therefrom. The transformed/transgenic inbred line was crossed with a different inbred line which does not have the transgene. The resulting hybrid line is herein referred to as GA20Ox_SUP/PpCOL/ZMM19 stack or triple vector stack. The parental lines of the GA20Ox_SUP/PpCOL/ZMM19 stack are the same as those used to produce the GA20Ox_SUP single.

For the transgenic single and stack plants, the corresponding control plants were also produced for comparison having the same parental line combination, but without the transgenic GA20Ox_SUP or GA20Ox_SUP/PpCOL/ZMM19 construct. In addition to the data provided herein, it has been shown that the PpCOL transgene in combination with the GA20Ox_SUP cassette can result in positive ear traits and increased yield in corn, relative to control plants (see PCT/US2019/018130, the entire contents and disclosure of which is incorporated herein by reference), and further that the ZMM19 transgene can result in positive root traits in corn plants, and the ZMM19 transgene in combination with the GA20Ox_SUP cassette can result in positive ear traits and increased yield in corn plants, relative to control plants (see PCT/US2019/018136, the entire contents and disclosure of which is incorporated herein by reference.

Example 2. Reduced Height of the GA20Ox_SUP/PpCOL/ZMM19 Stack Plants

GA20Ox_SUP/PpCOL/ZMM19 stack plants were grown to maturity in a field under standard agronomic practice and their heights were measured. Plant height was measured as the plot average from the soil line to the base of highest collared leaf at the R3 stage. Ear height was measured as the plot average from the soil line to the ear node at R3 stage. A sufficient number of plants were measured to meet statistical significance with a p-value≤0.2. Control plants of the same parental hybrid lines, but without the GA20Ox_SUP/PpCOL/ZMM19 transgenic construct, were also grown under similar conditions. Transgenic GA20Ox_SUP single plants were also grown under similar conditions.

FIG. 1 shows the average plant height reduction for GA20Ox_SUP/PpCOL/ZMM19 stack plants of two transgenic events, relative to the control plants. Each bar in the figure provides the average results for one transformation event. A statistically significant reduction in plant height averaging between 34 to 38% relative to control plants was consistently observed in GA20Ox_SUP/PpCOL/ZMM19 stack plants relative to control plants.

Figure 7:
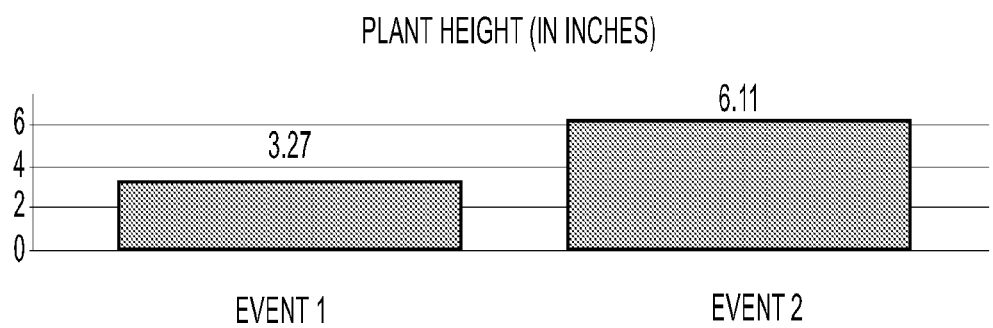
FIG. 7 shows plant heights of GA20Ox_SUP/PpCOL/ZMM19 stack plants across two events, relative to GA20Ox_SUP single plants.

FIG. 7 shows the average plant heights for GA20Ox_SUP/PpCOL/ZMM19 stack plants of two transgenic events, relative to the GA20Ox_SUP plants. This data was obtained from a separate growing season than for the data in FIG. 1. Each bar in the figure provides the average results for one transformation event. A statistically significant increase in plant height averaging between 3 to 6 inches relative to GA20Ox_SUP plants was observed in GA20Ox_SUP/PpCOL/ZMM19 stack plants.

To determine ear heights in plants containing the triple stack across various parental lines, several hybrids were tested by crossing the inbred line containing the GA20Ox_SUP/PpCOL/ZMM19 construct described in Example 1 with various different male tester lines. Hybrids of the same parental lines and testers were also produced for GA20Ox_SUP single plants and control plants not having the GA20Ox_SUP or GA20Ox_SUP/PpCOL/ZMM19 constructs.

Figure 8:
FIG. 8 shows ear heights of GA20Ox_SUP/PpCOL/ZMM19 stack plants across two events and two testers per event, relative to GA20Ox_SUP single plants.

FIG. 8 shows the average ear heights for GA20Ox_SUP/PpCOL/ZMM19 stack plants of two transgenic events and two tester lines in the same growing season as represented in FIG. 7, relative to the GA20Ox_SUP plants. Each bar in the figure provides the average results for one transformation event per tester. A statistically significant increase in ear height averaging between 1 to 2 inches relative to GA20Ox_SUP plants was observed in GA20Ox_SUP/PpCOL/ZMM19 stack plants.

Example 3. Enhanced Ear and Leaf Traits of GA20Ox_SUP/PpCOL/ZMM19 Stack Plants

Transgenic GA20Ox_SUP single and GA20Ox_SUP/PpCOL/ZMM19 stack plants were grown under standard agronomic practice. GA20Ox_SUP/PpCOUZMM19 stack plants from two transformation events were selected. Several corn ear traits were measured at the R6 stage, and green leaf numbers were measured at the R5 stage.

Ear area is measured as the plot average of the size of the area of an ear from a two-dimensional view. The measurement is conducted via imaging of the ear, including kernels and void. Typically, ten representative ears are measured per plot. Ear diameter is a measure of the plot average of the ear diameter measured as the maximal "wide" axis of an ear over its widest section. Ear length is a measure of the plot average of the length of an ear measured from the tip of the ear in a straight line to the base of the ear node. Ear volume is measured as the plot average of the volume of an ear calculated by measuring the diameter and estimating the resulting volume along the length of the ear (one row at a time), accounting for the shape/contour of the ear, but assuming that the ear is a perfect circle for each row. Ear void percentage measures the plot average of area percentage of void on an ear from a two-dimensional view. The measurement is done through imaging of ear, including kernels and void. Typically, ten representative ears are measured per plot. Ear tip void percentage measures the plot average of area percentage of void at the top 30% area of an ear from a two-dimensional view. The measurement is done through imaging of ear, including kernels and void. Typically, 10 representative ears are measured per plot.

Grain yield estimate is a conversion from the hand-harvested grain weight per area measurement, collected from a small section of a plot, to the equivalent number of bushels per acre, including adjustment to a standard moisture level. Ear fresh weight, also called fresh ear weight, measures the plot average of the weight of a fresh ear at the R6 stage. Kernels per ear measures the plot average of number of kernels per ear. It is calculated as (total kernel weight/(Single Kernel Weight*total ear count), where total kernel weight and total ear count are measured from ear samples from an area between 0.19 to 10 square meters. Single kernel weight measures the plot average of weight per kernel, calculated as the ratio of (sample kernel weight adjusted to a standard moisture level)/(sample kernel number). The sample kernel number ranges from 350 to 850.

Figure 2:
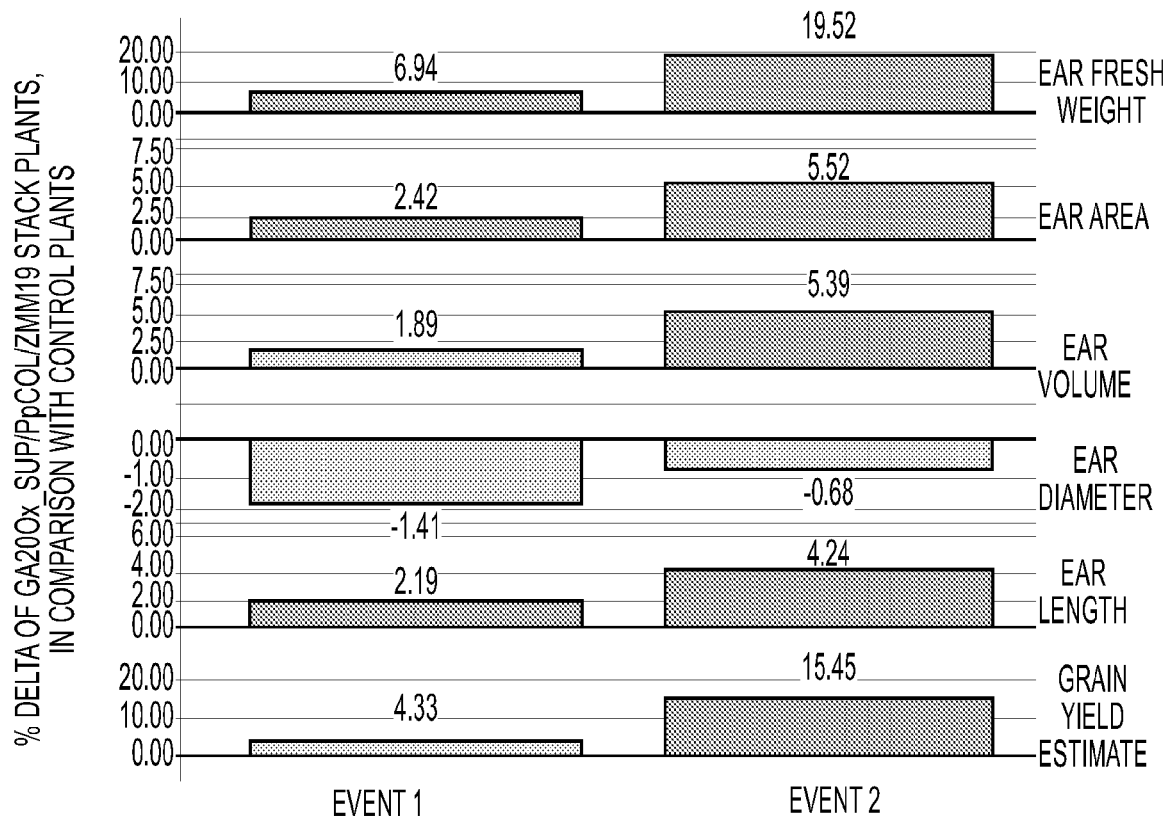
FIG. 2 shows ear traits of GA20Ox_SUP/PpCOL/ZMM19 stack plants across two transformation events including ear fresh weight, ear area, ear volume, ear diameter, ear length, and grain yield estimate, relative to control plants.

FIG. 2 shows ear trait and yield results for GA20Ox_SUP/PpCOL/ZMM19 stack plants of two transformation events in one growing season. Results are shown as percentage difference (delta) between GA20Ox_SUP/PpCOL/ZMM19 stack plants and control plants not having the GA20Ox_SUP or GA20Ox_SUP/PpCOL/ZMM19 construct. Each bar in the figure provides the average results for one transformation event. Dark gray bars indicate statistically significant differences (p-value≤0.2), and light gray bars indicate numerical differences (p-value>0.2). As shown in FIG. 2, significant increases in fresh ear weight, ear area, ear volume, ear length and grain yield estimate were observed for GA20Ox_SUP/PpCOL/ZMM19 stack plants, relative to the control plants.

Figure 3:
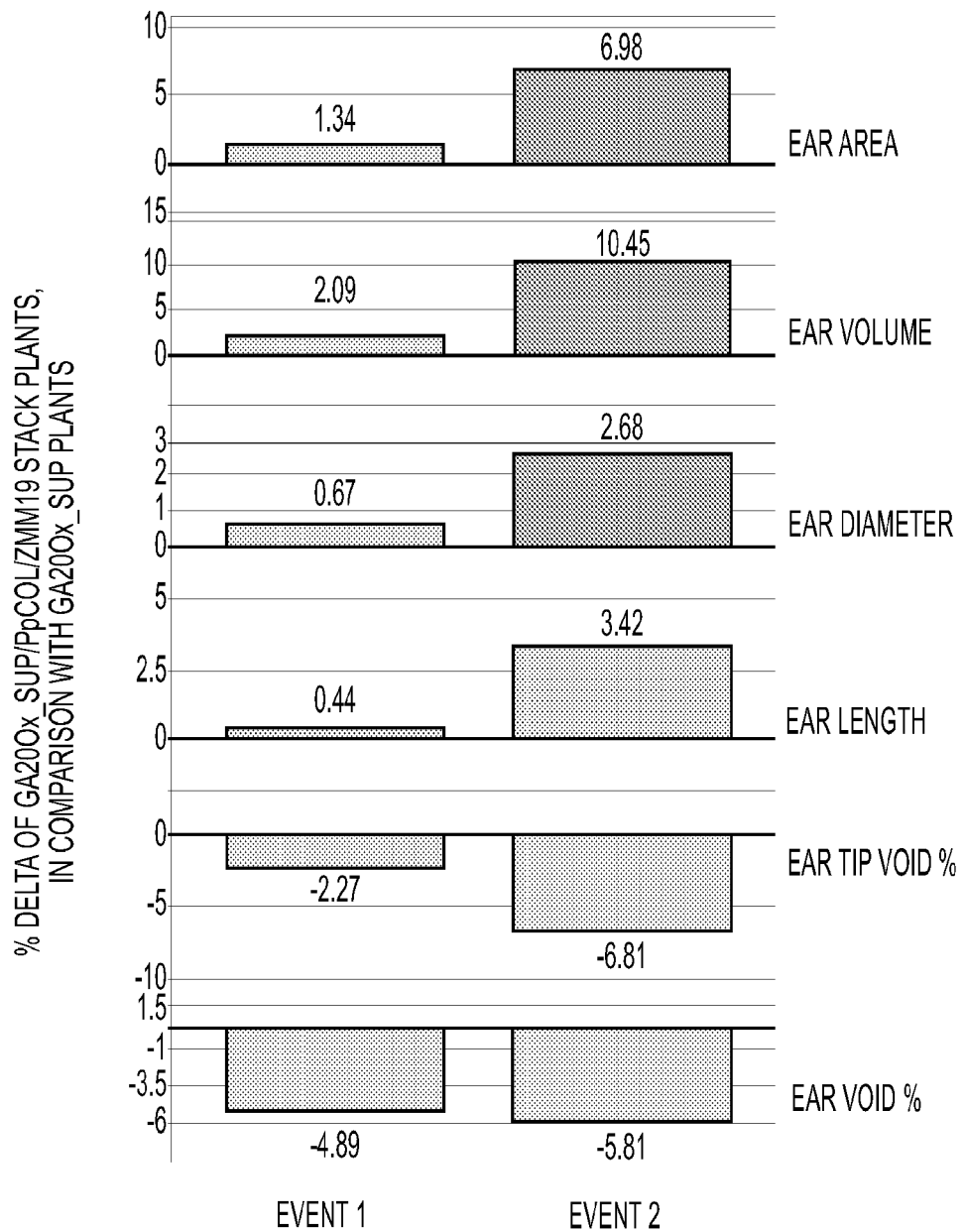
FIG. 3 shows ear traits of GA20Ox_SUP/PpCOL/ZMM19 stack plants across two transformation events including ear area, ear volume, ear diameter, ear length, ear tip void, and ear void, relative to GA20Ox_SUP single plants.

FIG. 3 further shows ear trait results for GA20Ox_SUP/PpCOL/ZMM19 stack plants from two transformation events in one growing season. Results are shown as percent difference (delta) of GA20Ox_SUP/PpCOL/ZMM19 stack plants over GA20Ox_SUP single plants. Each bar in the figure provides the results for one transformation event. Dark gray bars are indicative of statistically significant differences (p-value≤0.2), and light gray bars are indicative of numerical differences (p-value>0.2). As shown in FIG. 3 for at least one of the events, statistically significant increases in ear area, ear volume, ear diameter, and ear length were observed for GA20Ox_SUP/PpCOL/ZMM19 plants, and numerical decreases in ear tip void and ear void were also observed in GA20Ox_SUP/PpCOL/ZMM19 plants, relative to GA20Ox_SUP single plants.

Figure 4A:
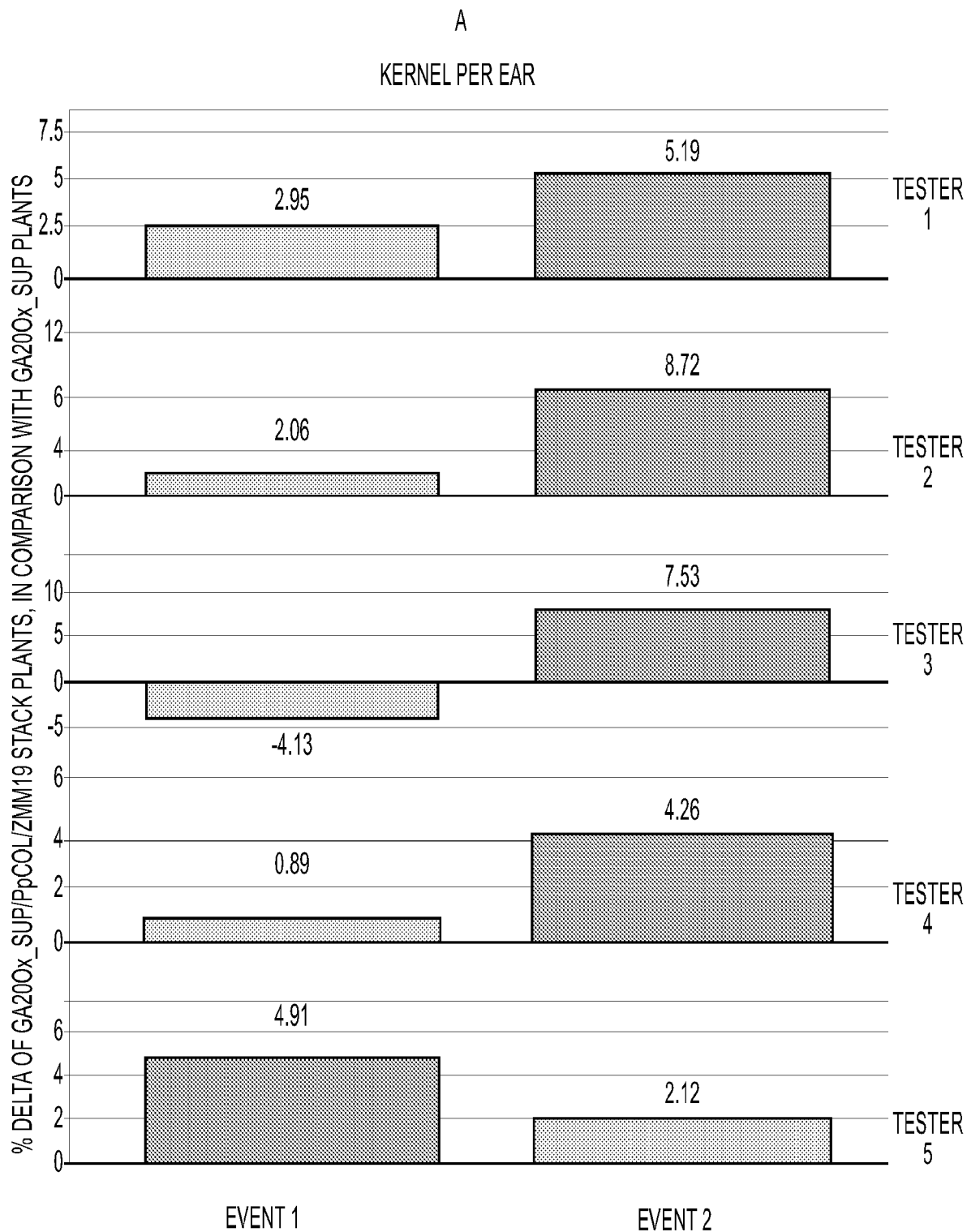
FIG. 4 shows ear traits of GA20Ox_SUP/PpCOL/ZMM19 stack plants across two transformation events with five different testers for each transformation event including kernels per ear and single kernel weight (panel A) and ear length and ear area (panel B), relative to GA20Ox_SUP single plants.
Figure 4B:
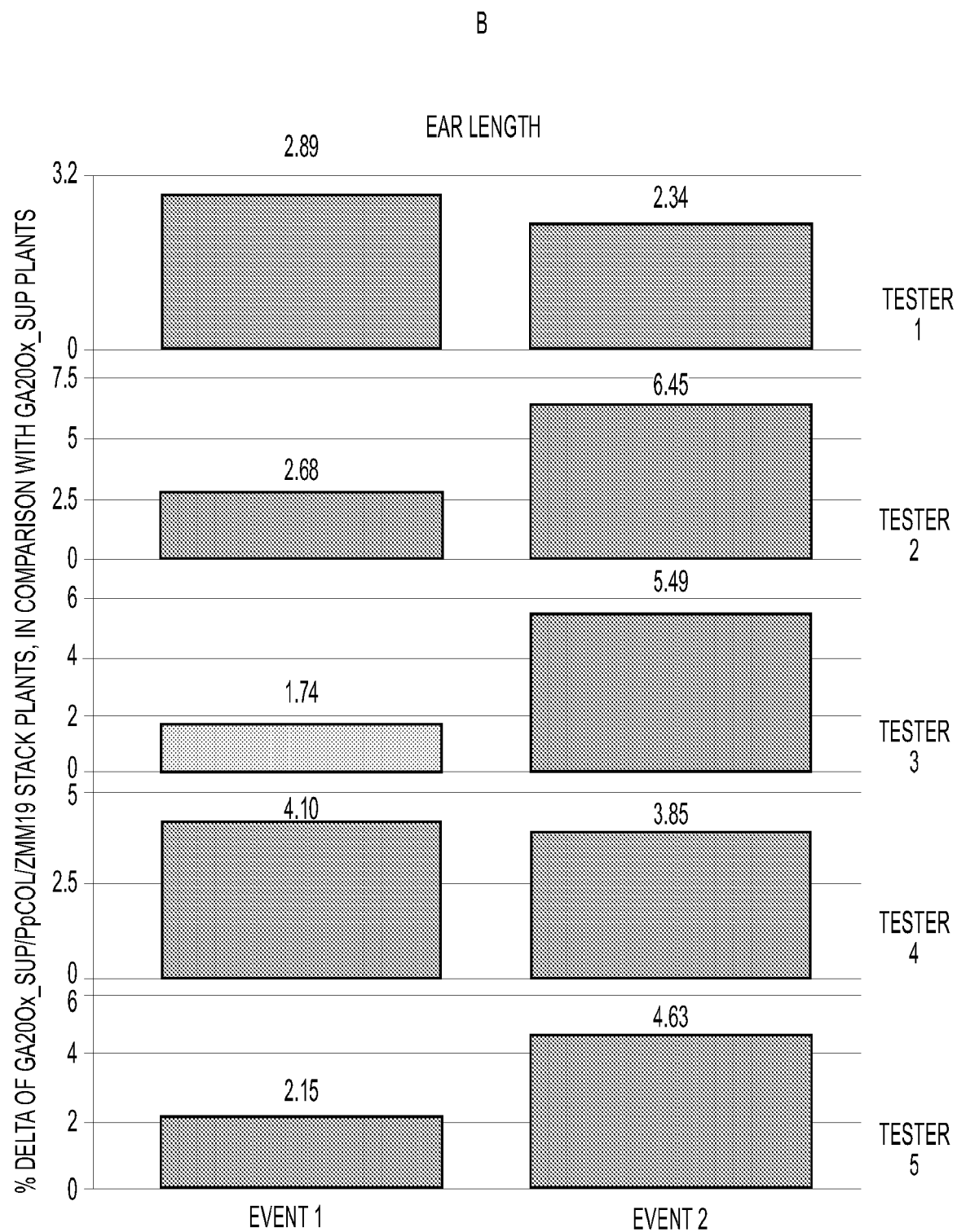

To understand the penetrance of ear traits across various parental lines, several hybrids were tested by crossing the inbred line containing the GA20Ox_SUP/PpCOL/ZMM19 construct described in Example 1 with five different male tester lines. Hybrids of the same parental lines and testers were also produced for GA20Ox_SUP single plants and control plants not having the GA20Ox_SUP or GA20Ox_SUP/PpCOL/ZMM19 constructs. Ear traits including kernels per ear, single kernel weight, ear length, and ear area were measured and compared to GA20Ox_SUP single plants as shown in FIG. 4. Each bar in the figure provides the average results for one transformation event. Dark gray bars are indicative of statistically significant differences (p-value≤0.2), and light gray bars are indicative of numerical differences (p-value>0.2). As shown in panel A of FIG. 4, statistically significant increases in kernels per ear and single kernel weight of GA20Ox_SUP/PpCOL/ZMM19 plants were observed for at least one of the events (Event 2) with four or five of the tester crosses, and with one or two of the tester crosses for the other transformation event (Event 1), relative to GA20Ox_SUP single plants. As shown in panel B of FIG. 4, statistically significant increases in ear length and ear area of GA20Ox_SUP/PpCOL/ZMM19 plants were observed for both transformation events (Event 1 and Event 2) with four or five of the tester crosses, relative to GA20Ox_SUP single plants.

Figure 9:
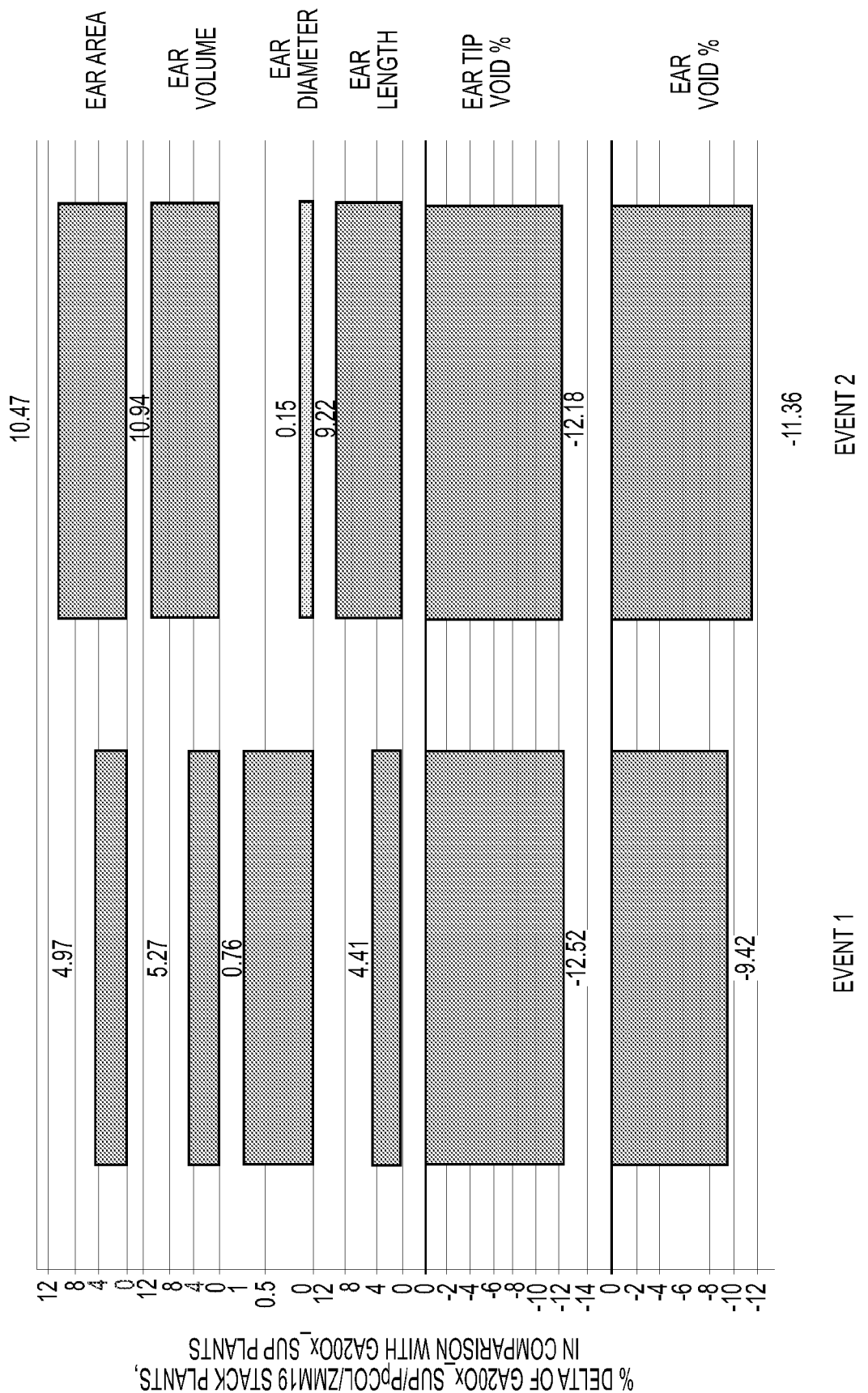
FIG. 9 shows ear traits of GA20Ox_SUP/PpCOL/ZMM19 stack plants across two transformation events including ear area, ear volume, ear diameter, ear length, ear tip void, and ear void, relative to GA20Ox_SUP single plants.
Figure 10:
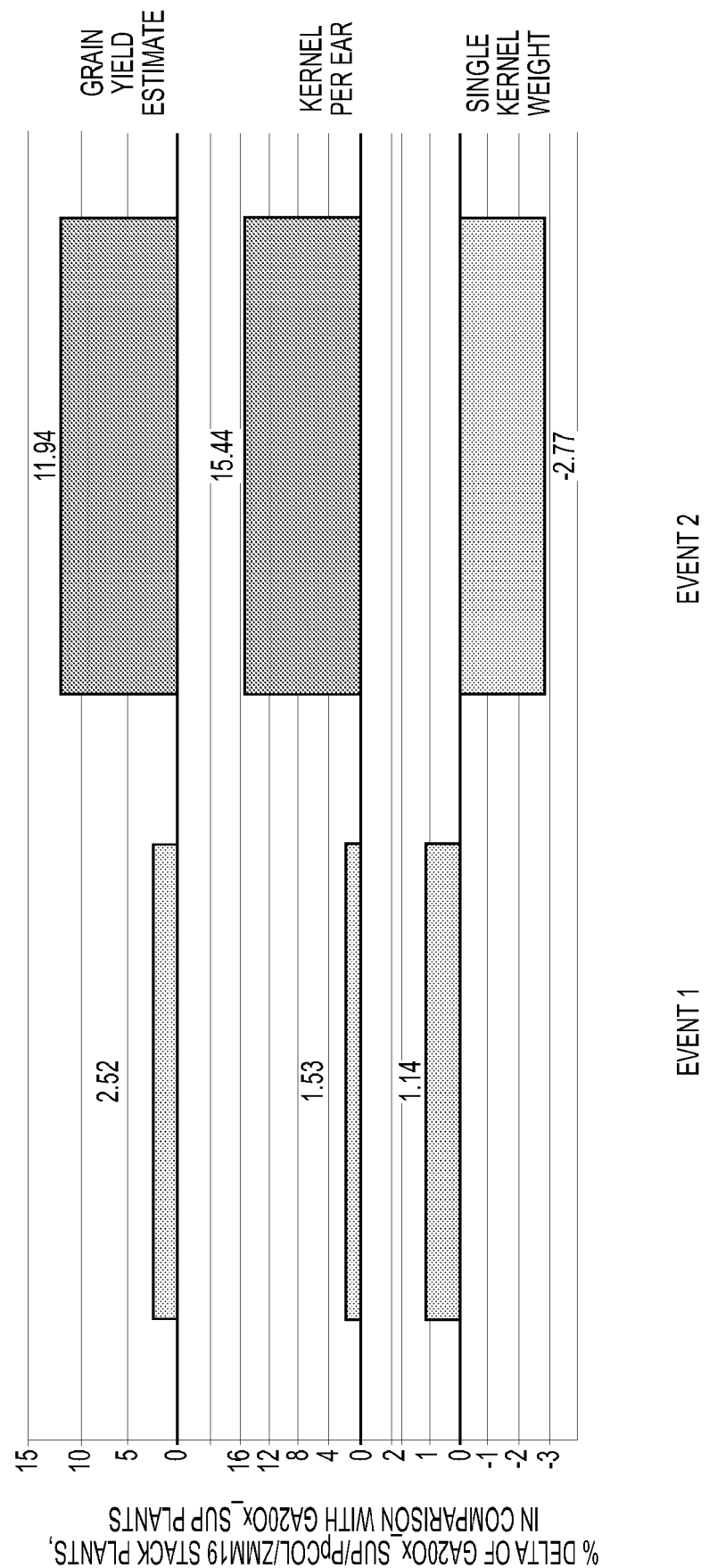
FIG. 10 shows ear traits of GA20Ox_SUP/PpCOL/ZMM19 stack plants across two transformation events including grain yield estimate, kernel per ear, and single kernel weight, relative to GA20Ox_SUP single plants.

Ear traits of hybrid plants with two events of the GA20Ox_SUP/PpCOL/ZMM19 stack are shown in FIG. 9, relative to GA20Ox_SUP single plants. Statistically significant increases in ear area, ear volume, ear diameter and ear length with one or both events, and statistically significant decreases in ear void percentage and ear tip void percentage, were observed in GA20Ox_SUP/PpCOL/ZMM19 plants. The kernel traits and grain yield estimates are shown in FIG. 10 for GA20Ox_SUP/PpCOL/ZMM19 plants, relative to GA20Ox_SUP single plants. Statistically significant increases in grain yield estimate and in kernel per ear were observed in 1 of 2 events.

Figure 11:
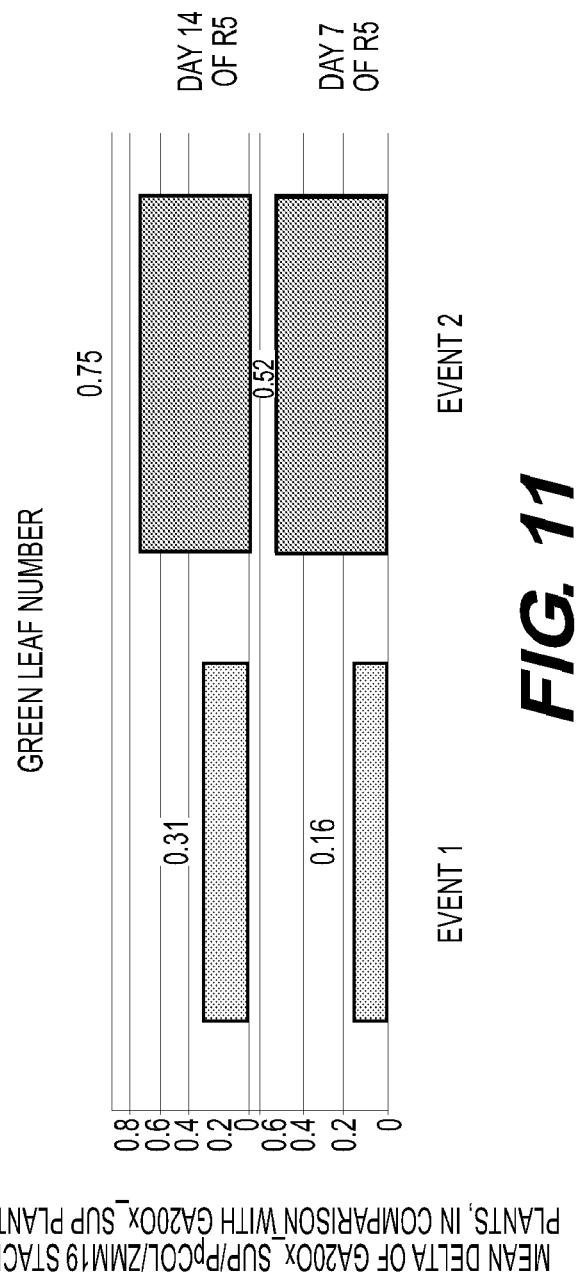
FIG. 11 shows green leave numbers of GA20Ox_SUP/PpCOL/ZMM19 stack plants across two transformation events at Day 7 and Day 14 into R5 stage, relative to GA20Ox_SUP single plants.

The average difference or delta in green leaf number at R5 stage across two transformation events of GA20Ox_SUP/PpCOL/ZMM19 stack plants are shown in FIG. 11, relative to GA20Ox_SUP single plants. Green leaf number is measured as the plot average of the number of green leaves, at various days after the onset of R5 growth stage (at Day 7 or 14 of R5 stage). Dark gray bars are indicative of statistically significant differences (p-value≤0.2), and light gray bars are indicative of numerical differences (p-value>0.2). GA20Ox_SUP/PpCOL/ZMM19 stack plants showed statistically significant increases in green leaf number as compared to the GA20Ox_SUP single plants, in 1 of 2 events, at Day 7 and Day 14 of R5 stage.

Example 4. Increased Yield of GA20Ox_SUP/PpCOL/ZMM19 Stack Plants

GA20Ox_SUP/PpCOL/ZMM19 stack plants having either of two transformation events were crossed to two different male tester lines, and hybrid progeny were grown under standard agronomic practice at 15 field locations in one growing season, along with the corresponding control plants without the GA20Ox_SUP or GA20Ox_SUP/PpCOL/ZMM19 transgene, and with the corresponding GA20Ox_SUP single plants. Sufficient numbers of plants were grown to conduct broad acre yield measurements.

Figure 5:
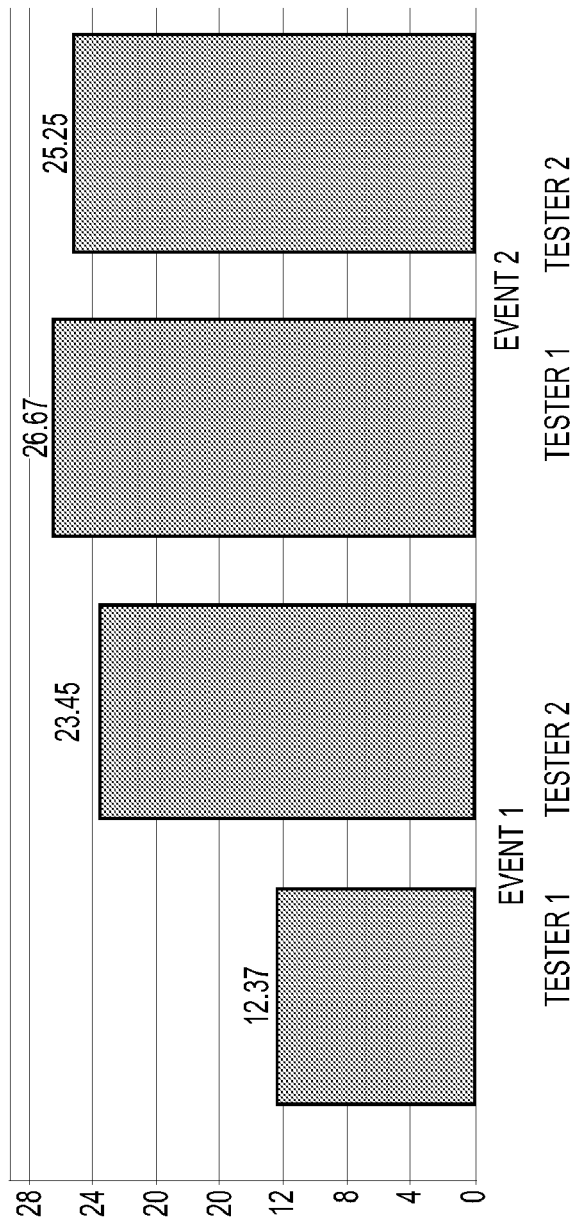
FIG. 5 shows broad acre yield of GA20Ox_SUP/PpCOL/ZMM19 stack plants across two transformation events with two different testers for each transformation event, relative to control plants.

As shown in FIG. 5, GA20Ox_SUP/PpCOL/ZMM19 stack plants had improved broad acre yield, relative to control plants not having the GA20Ox_SUP or to GA20Ox_SUP/PpCOL/ZMM19 transgene. Statistically significant increases in broad acre yield of over 12 bushels/acre for GA20Ox_SUP/PpCOL/ZMM19 stack plants were observed relative to control plants, across all tested events and testers.

Figure 6:
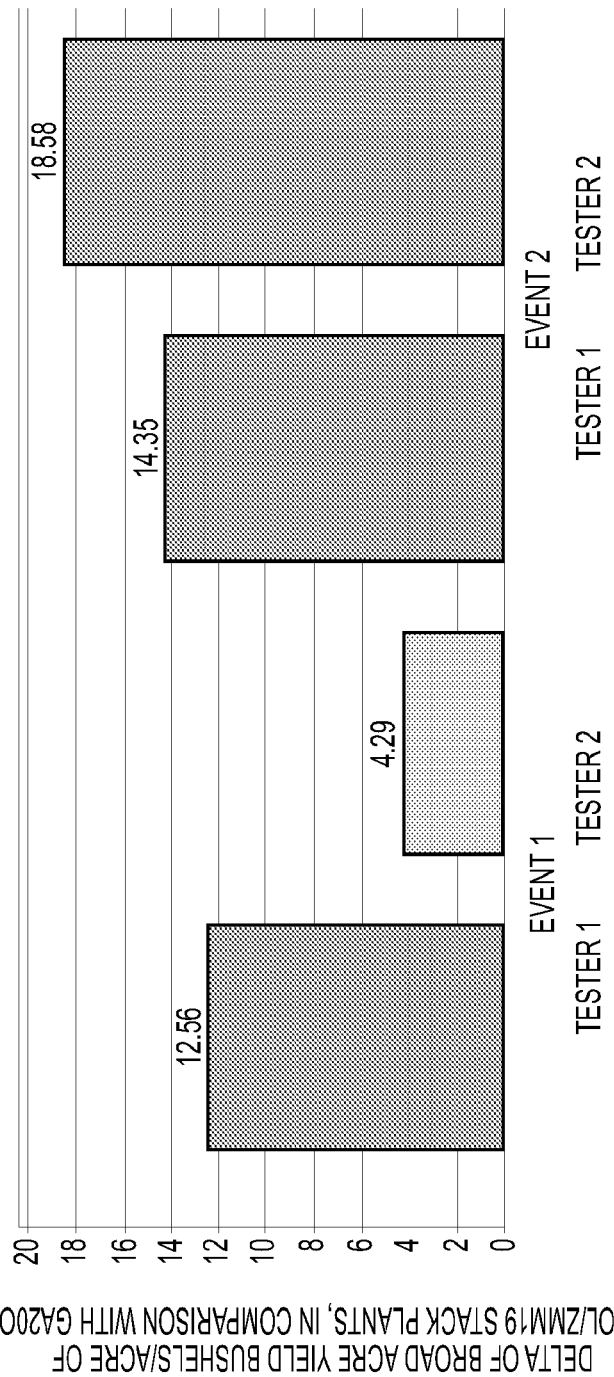
FIG. 6 shows broad acre yield of GA20Ox_SUP/PpCOL/ZMM19 stack plants across two transformation events with two different testers for each transformation event, relative to GA20Ox_SUP single plants.

As shown in FIG. 6, GA20Ox_SUP/PpCOL/ZMM19 stack plants had improved broad acre yield, relative to GA20Ox_SUP single plants. Results are shown as the percentage difference (delta) in broad acre yield (bushels/acre) of GA20Ox_SUP/PpCOL/ZMM19 stack plants relative to the reference plants. Each bar provides the results for one transformation event. Dark gray bars are indicative of statistically significant differences (p-value≤0.2), and light gray bars are indicative of numerical differences (p-value>0.2). Three out of four event/tester combinations of GA20Ox_SUP/PpCOL/ZMM19 stack plants showed statistically significant increases in broad acre yield by at least 12 bushels/acre, relative to GA20Ox_SUP single plants.

Figure 12:
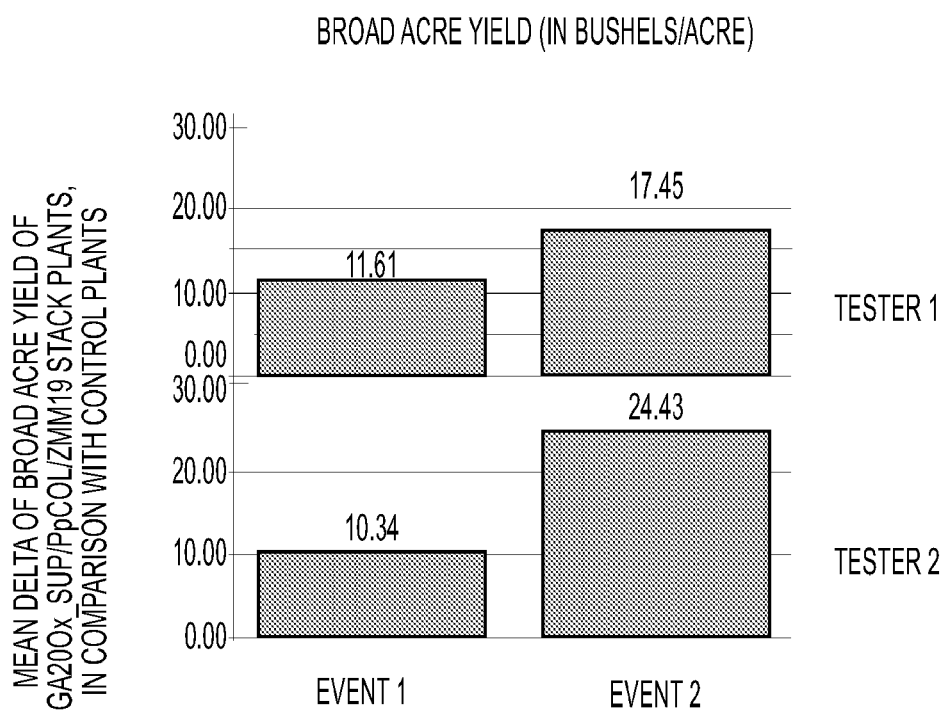
FIG. 12 shows broad acre yield of GA20Ox_SUP/PpCOL/ZMM19 stack plants across two transformation events with two different testers for each transformation event, relative to control plants.
Figure 13:
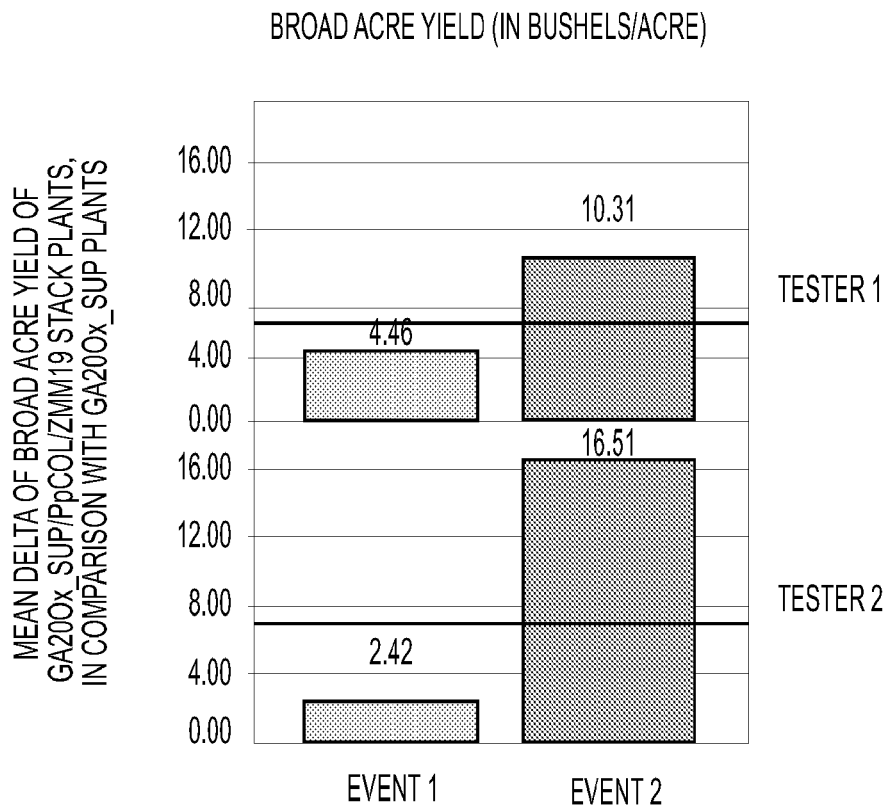
FIG. 13 shows broad acre yield of GA20Ox_SUP/PpCOL/ZMM19 stack plants across two transformation events with two different testers for each transformation event, relative to GA20Ox_SUP single plants.

GA20Ox_SUP/PpCOL/ZMM19 stack plants showed increased broad acre yield in a second growing season for two transformation events with two different testers per event, in comparison GA20Ox20_SUP single (FIG. 12) and non-transgenic control (FIG. 13) plants. Dark gray bars are indicative of statistically significant differences (p-value≤0.1), and light gray bars are indicative of numerical differences (p-value>0.1). GA20Ox_SUP/PpCOL/ZMM19 stack plants had statistically increased broad acre yield with both events relative to control plants, and statistically significant increased broad acre yield for one event by greater than 10 bushels/acre and a numerically increased broad acre yield for the other of the two events, relative to GA20Ox_SUP single plants.

Taken together, increased broad acre yield was observed for hybrid GA20Ox_SUP/PpCOL/ZMM19 stack plants over GA20Ox_SUP single and control plants across two consecutive growing seasons, as shown in FIGS. 5 and 6 and FIGS. 12 and 13, with multiple transformation events and parental hybrid testers.

Example 5. Identification of Homologs of CONSTANS (CO), CONSTANS-Like (COL) and ZMM19 Genes Sixty-eight CONSTANS (CO) and CONSTANS-like (COL) homologs were identified from *Arabidopsis*, rice, soybean, and barley, and the CO/COL protein sequences were further searched in the genetic sequence database Genbank® to identify additional CO/COL homologs from various plant species using BlastP (e-value cutoff of 1e-10). The preliminary search results were then filtered to identify those having a full amino acid sequence with a starting methionine, and a CCT domain (HMMSEARCH vs. CCT Pfam, using gathering threshold cutoff) and one or two Zinc finger B-box domain(s) (HMMERSEARCH vs. zf-B_box Pfam, using gathering threshold cutoff). Compiled results of these searches include proteins having the following amino acid sequences: SEQ ID NOs: 182-403 (single B-box domain) and SEQ ID NOs: 404-458 (two B-box domains). These CO or COL gene homologs may be used in expression cassettes, constructs and transgenic plants as provided herein.

Twenty-five MADS-box homologs were identified from the following species: bread wheat, domesticated barley, Indian rice, Japanese rice, maize, perennial ryegrass, sorghum, and tall fescue. The *Zea mays* ZMM19 protein sequences were further searched in Genbank® to identify additional MADS-box homologs from various plant species using BlastP (e-value cutoff of 1e-10). Preliminary search results were then filtered to identify those having a full amino acid sequence with a starting methionine and SRF-TF and K-box Pfam domains having at least 70% sequence identity to *Zea mays* ZMM19 protein. Compiled results of these searches include proteins having amino acid sequences as set forth in SEQ ID NOs: 459-483. These MADS-box or ZMM19 gene homologs may be used in expression cassettes, constructs and transgenic plants as provided herein.

Example 6. Generation of the PpCOL Single Plants, ZMM19 Single Plants and PpCOL/ZMM19 Inbred Stack Plants An inbred corn plant line was transformed via *Agrobacterium*-mediated transformation with a transformation vector having a construct of an expression cassette comprising an *Oryza sativa* enhancer (SEQ ID NO: 170), a CaMV 35S enhancer (SEQ ID NO: 171), an *Oryza sativa* promoter (SEQ ID NO: 172), a leader sequence (SEQ ID NO: 173), an intron sequence (SEQ ID NO: 174), and a terminator sequence (SEQ ID NO: 175), operably linked to a polynucleotide sequence (SEQ ID NO: 169) encoding *Physcomitrella patens* CONSTANS-like 1 (PpCOL1) polypeptide (SEQ ID NO: 168). Several transformation events were generated therefrom.

Similarly, the same inbred corn plant line was transformed via *Agrobacterium*-mediated transformation with a transformation vector having a construct of an expression cassette comprising an Oryza sativa Rcc3 gene promoter region (SEQ ID NO: 178), a leader sequence thereof (SEQ ID NO: 179), a *Zea mays* intron sequence (SEQ ID NO: 180), and an *Oryza sativa* UP2 terminator region (SEQ ID NO: 181), operably linked to a polynucleotide sequence (SEQ ID NO: 177) encoding maize ZMM19 polypeptide (SEQ ID NO: 176). Several transformation events were generated therefrom.

The transformed PpCOL and ZMM19 plants of the same inbred line were crossed with each other. The resulting inbred plants containing both transgenes or constructs can be referred to as the PpCOL/ZMM19 stack or inbred stack, which can be tested in comparison to the parental PpCOL and ZMM19 single plants in the same inbred background.

Control plants lacking both of the PpCOL and ZMM19 constructs in the same inbred lines were also used for comparison.

Example 7. Increased Height of the PpCOL/ZMM19 Inbred Stack Plants

PpCOL/ZMM19 stack plants were grown to maturity in a field under standard agronomic practice and their heights were measured. Plant height was measured as the plot average from the soil line to the base of highest collared leaf at the R3 stage. A sufficient number of plants were measured to meet statistical significance with a p-value≤0.2. Control plants of the same inbred line, but without the PpCOL or ZMM19 transgenic constructs, were grown under similar conditions. Transgenic PpCOL single plants and ZMM19 single plants were also grown under similar conditions. Two events of each of the PpCOL and ZMM19 single plants were grown. The PpCOL/ZMM19 stack plants included 4 event combinations (2 from each of the parent transgenic single plants).

Figure 14:
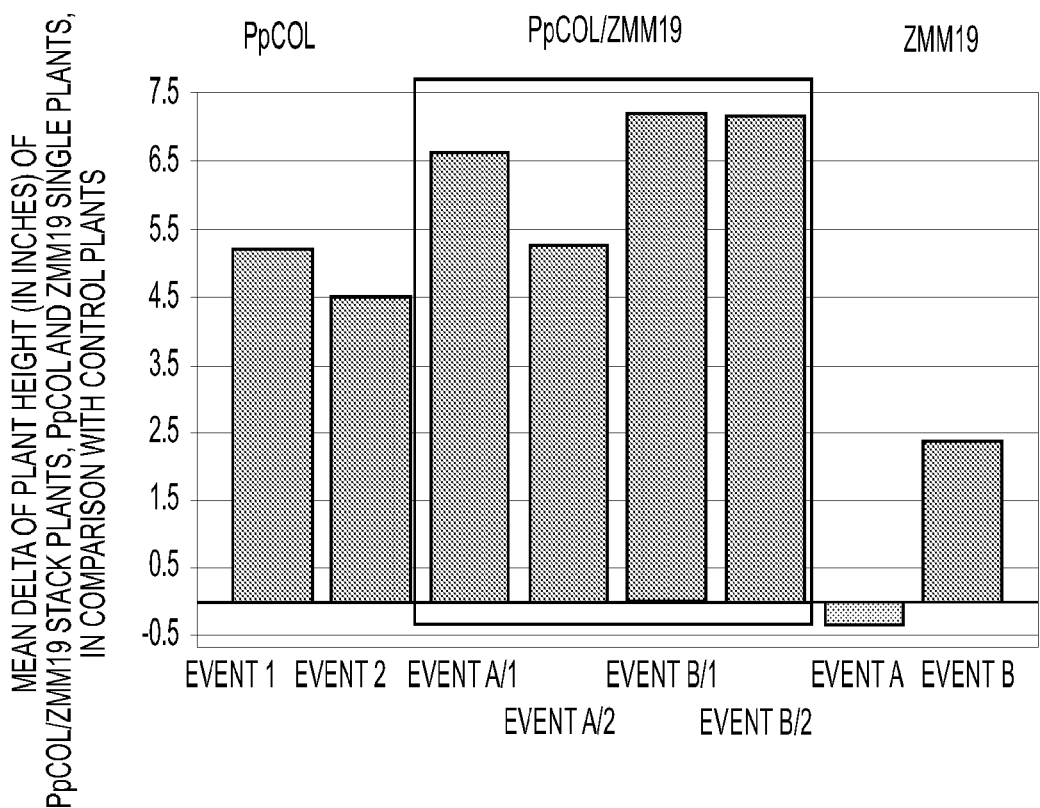
FIG. 14 shows plant height difference at R3 stage of PpCOL single, ZMM19 single, and PpCOL/ZMM19 stack inbred plants, relative to control plants. PpCOL single transgenic corn plants ("PpCOL single") comprise a transgene encoding *Physcomitrella patens* CONSTANS-like 1 (PpCOL1) polypeptide for two transformation events. ZMM19 single transgenic corn plants ("ZMM19 single") comprise a transgene encoding maize ZMM19 polypeptide for two transformation events. PpCOL/ZMM19 stack inbred plants were produced through inbred crossing of the PpCOL and ZMM19 single plants, each of which having 2 events, for a total of 4 event combinations.

FIG. 14 shows the average plant height increases for the 4 event combinations of PpCOL/ZMM19 stack plants, relative to the control plants. Each bar in the figure provides the average results for one transformation event of single plants, or in the case of the stack plants, a unique combination of parental events. Dark gray bars indicate statistically significant differences (p-value≤0.2), and light gray bars indicate numerical differences (p-value>0.2). A statistically significant increase in stack plant height averaging between 6 to 7 inches relative to control plants was observed in PpCOL/ZMM19 stack plants across all 4 event combinations. In comparison, a statistically significant increase in stack plant height averaging about 5 inches relative to control plants was observed in PpCOL single plants across both events. As for ZMM19 single plants, one of two events showed a statistically significant increase of plant height of about 2.5 inches relative to control plants.

Example 8. Delayed Flowering and Increased Green Leaf Count of the PpCOL/ZMM19 Inbred Stack Plants Transgenic PpCOL and ZMM19 single and PpCOL/ZMM19 inbred stack plants and control plants (without either PpCOL or ZMM19 construct) were grown under standard agronomic practice. PpCOL and ZMM19 single plants each from two transformation events, and PpCOL/ZMM19 stack plants from all 4 combinations of parental events were selected. Flowering time of pollen and silk was measured, and green leaf number was measured at the R5 stage. Pollen shed measures the number of days from the date of planting to the date when 50% of the plants in a plot reaches pollen shedding within R1 stage, and silking measures the number of days from the date of planting to the date when 50% of the plants in a plot reaches visible silking within R1 stage.

Figure 15:
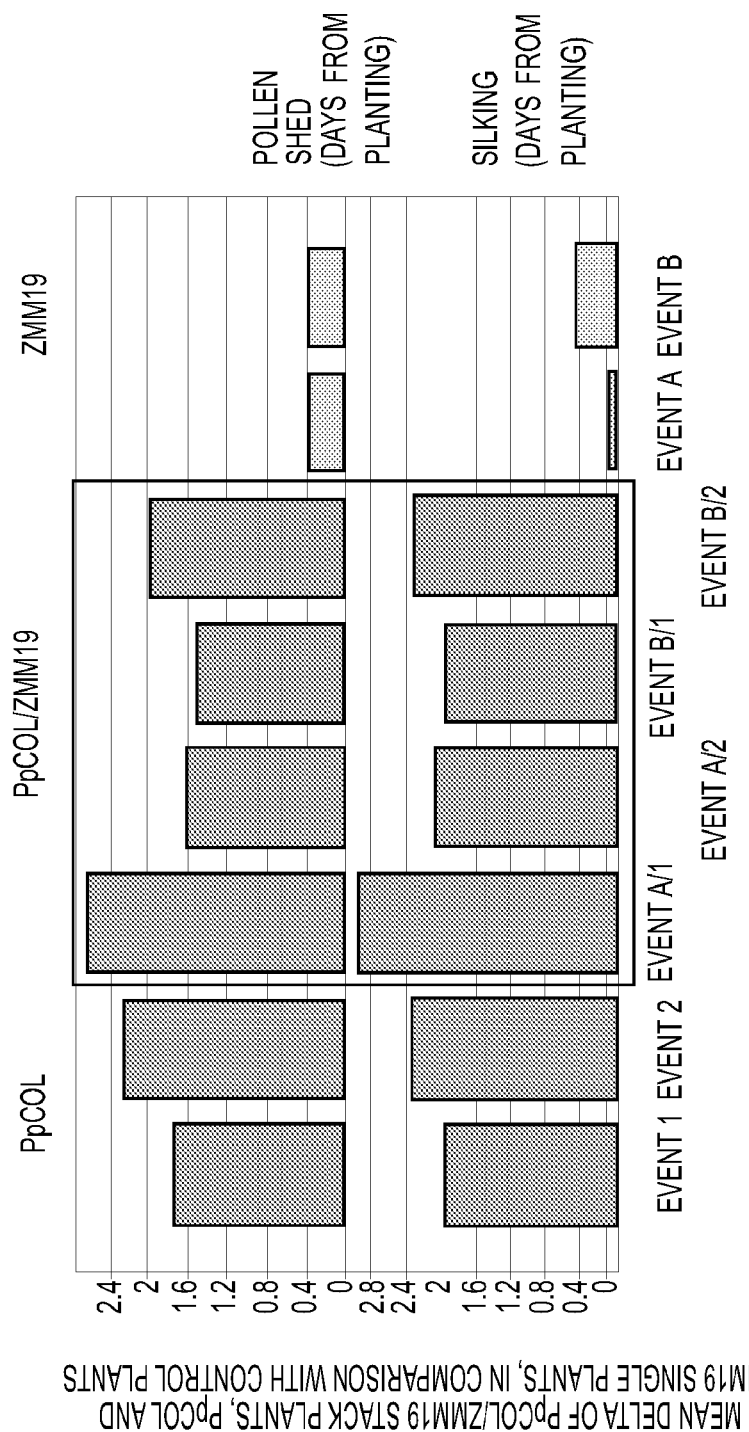
FIG. 15 shows reproductive trait differences of PpCOL single, ZMM19 single, and PpCOL/ZMM19 stack inbred plants, including pollen shed and silking time in days into R1 stage, relative to control plants.

FIG. 15 shows average change in timing for pollen shed and silking reproductive or flowering traits of transgenic single or stack plants across events, relative to control plants. Each bar in the figure provides the average results for one transformation event of single plants, or in the case of the stack plants, a unique combination of parental events. Dark gray bars indicate statistically significant differences (p-value≤0.2), and light gray bars indicate numerical differences (p-value>0.2). PpCOL/ZMM19 stack plants and PpCOL single plants were observed to have an average delay of about 2 days in pollen shed and silking, relative to the control plants, whereas ZMM19 single plants had similar timing for these traits as control plants.

Figure 16:
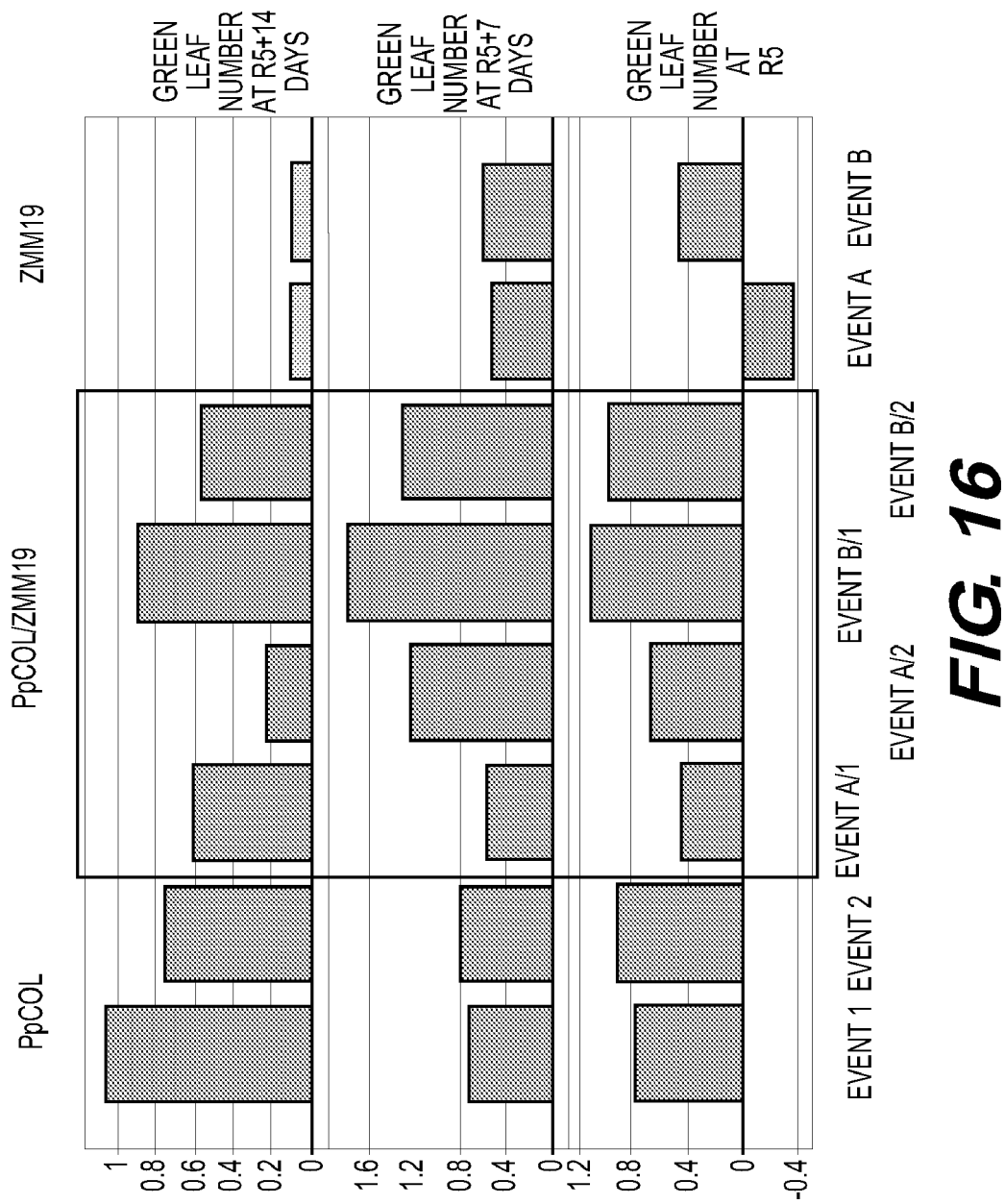
FIG. 16 shows green leaf count differences of PpCOL single, ZMM19 single, and PpCOL/ZMM19 stack inbred plants, at the onset of, and at 7 and 14 days into R5 stage, relative to control plants.

FIG. 16 shows average green leaf number of the transgenic plants, at onset of R5 stage, and at 7 and 14 days after onset of R5, relative to the control plants. Each bar in the figure provides the average results for one transformation event of single plants, or in the case of the stack plants, a unique combination of parental events. Dark gray bars indicate statistically significant differences (p-value≤0.2), and light gray bars indicate numerical differences (p-value>0.2). Both the PpCOL/ZMM19 stack plants and PpCOL single plants were observed to have higher green leaf number than the control plants, ranging in average from 0.2 to 1.7 at different time points of development in R5 stage.

Example 9. Enhanced Ear and Yield-Associated Traits of PpCOL/ZMM19 Inbred Stack Plants Transgenic PpCOL and ZMM19 single and PpCOL/ZMM19 inbred stack plants, and control plants without either PpCOL or ZMM19 construct, were grown under standard agronomic conditions. PpCOL and ZMM19 single plants each from two transformation events, and PpCOL/ZMM19 stack plants from all 4 combinations of parental events were selected. Several ear traits associated with increased yield potential were measured at the R6 stage.

Figure 17:
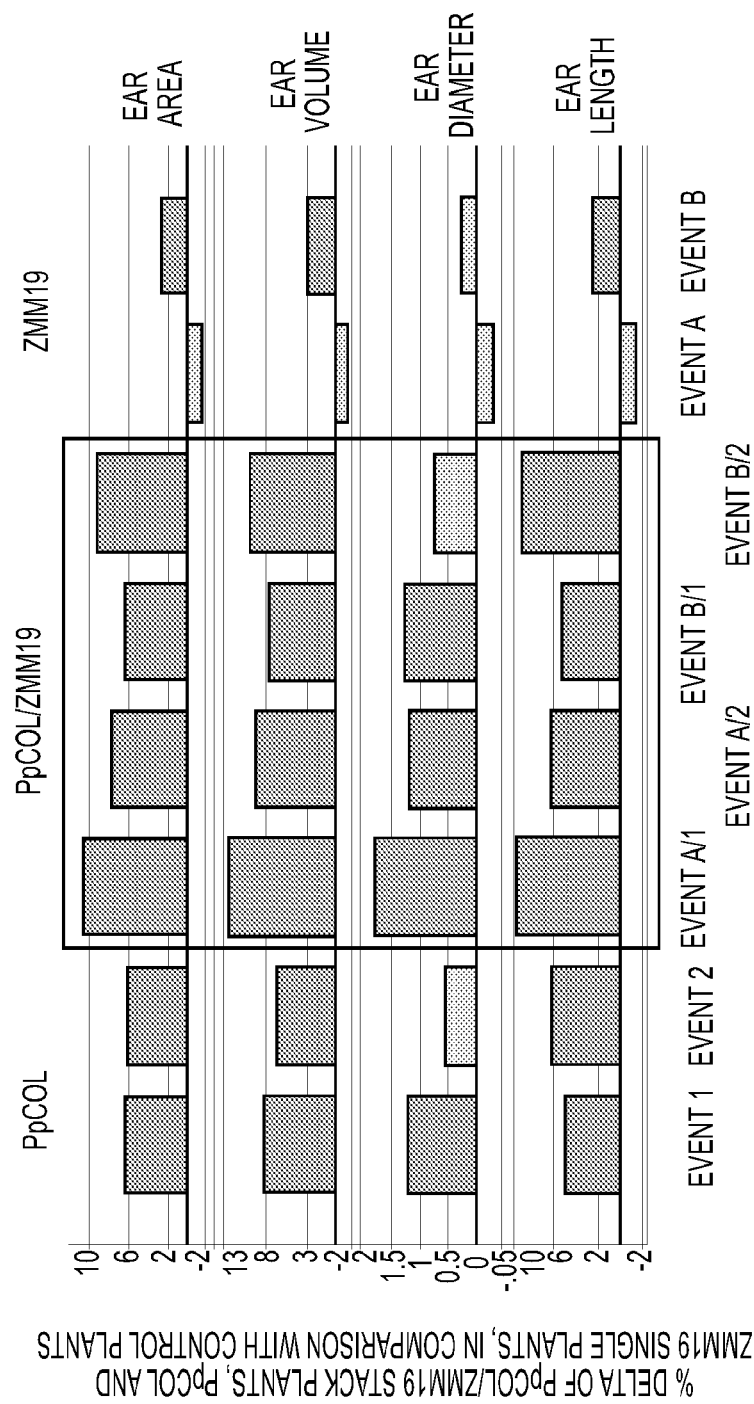
FIG. 17 shows differences in ear traits difference of PpCOL single, ZMM19 single, and PpCOL/ZMM19 stack inbred plants, including ear area, ear volume, ear diameter and ear length, relative to control plants.

FIG. 17 shows ear traits including ear area, ear volume, ear diameter and ear length of transgenic single and stack plants relative to control plants. Results are shown as percentage difference (delta) of the transgenic single and stack plants versus control plants not having the PpCOL or ZMM19 construct. Each bar in the figure provides the average results for one transformation event of single plants, or in the case of the stack plants, a unique combination of parental events. Dark gray bars indicate statistically significant differences (p-value≤0.2), and light gray bars indicate numerical differences (p-value>0.2). The ear traits include ear area, ear volume, ear diameter and ear length.

Figure 18:
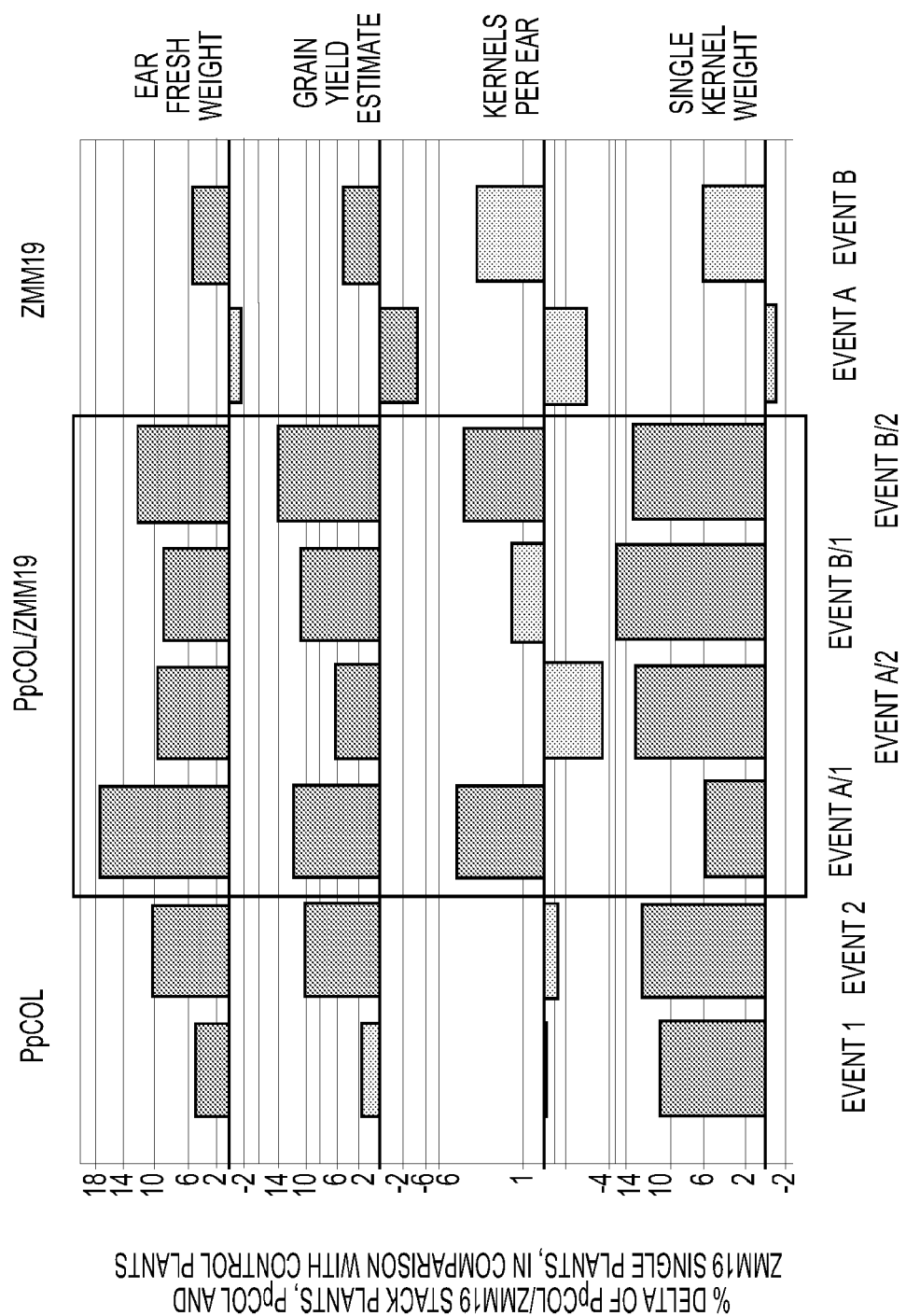
FIG. 18 shows differences in yield-associated traits of PpCOL single, ZMM19 single, and PpCOL/ZMM19 stack inbred plants, including ear fresh weight, grain yield estimate, kernels per ear and single kernel weight, relative to control plants.

FIG. 18 shows several ear or yield-associated traits including ear fresh weight, grain yield estimate, kernels per ear and single kernel weight of transgenic single and stack plants relative to control plants. Results are shown as percentage difference (delta) of single and stack plants versus control plants (not having PpCOL or ZMM19 construct). Each bar in the figure provides the average results for one transformation event of single plants, or in the case of the stack plants, a unique combination of parental events. Dark gray bars indicate statistically significant differences (p-value≤0.2), and light gray bars indicate numerical differences (p-value>0.2).

As shown in FIG. 17 and FIG. 18, statistically significant increases in ear area, ear volume, ear length, ear fresh weight, single kernel weight and grain yield estimate were observed for PpCOL/ZMM19 stack plants across all tested event combinations, relative to the control plants, and statistically significant increases in ear diameter and kernels per ear were observed for PpCOL/ZMM19 stack plants across 2 or 3 of the four tested event combinations, relative to the control plants. The increases on these traits were also observed for PpCOL/ZMM19 stack plants, relative to the PpCOL and ZMM19 single plants respectively.

The PpCOL/ZMM19 stack plants in Examples 7, 8 and 9 comprise a root preferred transgenic expression of the ZMM19 gene, which may improve root and shoot growth by regulating vegetative growth and development, and transgenic expression of PpCOL1 gene, which may improve ear traits and other traits associated with improved yield potential. Taken together, the PpCOL/ZMM19 stack plants demonstrated positive trait interactions, enhancements or advantages over the control plants and PpCOL and ZMM19 single plants that may have potential to improve crop yield or stability across growing seasons and/or different growing environments.

Having described the present disclosure in detail, it will be apparent that modifications, variations, and equivalent aspects are possible without departing from the spirit and scope of the present disclosure as described herein and in the appended claims. Furthermore, it should be appreciated that all examples in the present disclosure are provided as non-limiting examples.

SEQUENCE LISTING (491 sequences)

SEQ ID NO: 1 - DNA, 1741 bp, Zea mays
gacggtagttttcatctaaagtttattcttcgtcacatgggatggccgtttgcttgtttgttgcttccgggaggcggtggtgaattgaagcagatcgacaagcatggctgcccactggtctcgatcgatcggcctgccatgccatgccatgccactagagtccgtcctgactggccgcccgttcccccgtataaaaaggcaggcaggcaggcagagcggggacgagcaagcaagcagttgcagttgcagcggcctcctcctctgcttcctccctcctcctcctcaccatggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtaggcatgctatttgggtatggaagatggtggatgtaagcaaacaaagccaaattaagcagagtaggttaattaaggttggctgatgatccatttagggaaggagctgatctccctgactccctcctccaattttctcaaccaaatttatatagtataataataataataaaatagcaagtaatagttgtatcgtattattattaattaatttattagctggtaggcaagtagtattaaataccatttgtagtacgatgggcgtatttctattttggcgttttgctctgtgttttttgacgtttcctttggatttggggggacctcagatcagctcggcct

SEQ ID NO: 2 - DNA, 1116 bp, Zea mays
atggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtag

SEQ ID NO: 3 - protein, 371 aa, Zea mays
MVLAAHDPPPLVFDAARLSGLSDIPQQFIWPADESPTPDSAEELAVPLIDLSGDAAEVVRQVRRACDLHGFFQVVGHGIDAALTAEAHRCMDAFFTLPLPDKQRAQRRQGDSCGYASSFTGRFASKLPWKETLSFRYTDDDDGDKSKDVVASYFVDKLGEGYRHHGEVYGRYCSEMSRLSLELMEVLGESLGVGRRHFRRFFQGNDSIMRLNYYPPCQRPYDTLGTGPHCDPTSLTILHQDDVGGLQVFDAATLAWRSIRPRPGAFVVNIGDTFMALSNGRYRSCLHRAVVNSRVARRSLAFFLCPEMDKVVRPPKELVDDANPRAYPDFTWRTLLDFTMRHYRSDMRTLEAFSNWLSTSSNGGQHLLEKK

SEQ ID NO: 4 - DNA, 1517 bp, Zea mays
caggaataaaataagcctccgcccggcttcgttgcatccacgcacgcagcaagcgatcggatttcgccagcatggcggcggcggccgtggtgttcgacgccgaggcgctgagccgggaggagcacatcccggcgcagttcgtgtggcccaccgaggagcgggcgccggcgggcggcgtggaggaggtcgccatccccgtggtcgacctcggcgagttcctccgccgcggggtgctcccgcgcggcgtggcggaggcgtgcgagcgccacggcgtcttccaggtggtgaaccacggcgtgggcgccgcgctgctcgccgaggcctaccgctgttgcgacgccttttacgcgctcccgctcgcggacaagcagcgcgcgcagcgccggcacggggagaaccacggctacgccagcagcttcacgggccgcttccactgctgcctgccgtggaaggagacgctgtccttcaactgccccgccggtgccgggactgcgcgcgccgtcgtcggctacttcgtcgacgtcctcggcgaggactaccgccacatgggggaggtgtaccaggagtactgcgacgcgatgacgcgtctggcgctggacgtgacggaggtgctggcggcagcgctggggctggaccgcggcgcactgcgcggcttcttcgagggcggcgactccgtcatgcggctgaaccactacccggcgtgccggcagccgcacctgacgctggggacgggcccgcaccgggacccgacgtcgctgacgctgctgcaccaggacgacgtgggcgggctgcaggtgcgcgccggcggcgggccgtggcgcgcggtgcggccccgcgcggacgcgttcgtggtcaacattggcgacaccttcgccgcgctcaccgacgggcgtcacaccagctgcctgcaccgcgccgtggtgaccggcggcggctcccgccggtcgctcgccttcttcctcaacccgccgctggaccgcgtcgtccgcccgccgggcgcgctcctccaggagaacaagcaggcgggccgcccgcgcgcgttcccggacttcacgtggcgcgagttcctcgagttcacgcagaagcactaccggtcggacgcgggcaccatggacgccttcgtgtcgtggatcgcgggaggccgccgccaccatggcggacaggaggagggcaactgagatcgatgcatctctagctgtaggcagcagcgcagcagctaccaagaataatggccggcgacggagatgcagctacgacgcacaaataaattgagtgtttgtggtacaataaggacgaggacgatcaatggcgacctgtaaccggtgcagttttagttaatctttcatggcgatatggcattaaccaatcgttggtgtaaaatgcgtgcatgctttgcatgccaatgttggccatgtgatggcacagcgtgagtgtagctcacccaccgtgacaacgtgctaatttcgtgtggtcctagataccaaggtcgtctaatgaacttgatggattgatgattt

SEQ ID NO: 5 - DNA, 1107 bp, Zea mays
atggcggcggcggccgtggtgttcgacgccgaggcgctgagccgggaggagcacatcccggcgcagttcgtgtggcccaccgaggagcgggcgccggcgggcggcgtggaggaggtcgccatccccgtggtcgacctcggcgagttcctccgccgcggggtgctcccgcgcggcgtggcggaggcgtgcgagcgccacggcgtcttccaggtggtgaaccacggcgtgggcgccgcgctgctcgccgaggcctaccgctgttgcgacgccttttacgcgctcccgctcgcggacaagcagcgcgcgcagcgccggcacggggagaaccacggctacgccagcagcttcacgggccgcttccactgctgcctgccgtggaaggagacgctgtccttcaactgccccgccggtgccgggactgcgcgcgccgtcgtcggctacttcgtcgacgtcctcggcgaggactaccgccacatgggggaggtgtaccaggagtactgcgacgcgatgacgcgtctggcgctggacgtgacggaggtgctggcggcagcgctggggctggaccgcggcgcactgcgcggcttcttcgagggcggcgactccgtcatgcggctgaaccactacccggcgtgccggcagccgcacctgacgctggggacgggcccgcaccgggacccgacgtcgctgacgctgctgcaccaggacgacgtgggcgggctgcaggtgcgcgccggcggcgggccgtggcgcgcggtgcggccccgcgcggacgcgttcgtggtcaacattggcgacaccttcgccgcgctcaccgacgggcgtcacaccagctgcctgcaccgcgccgtggtgaccggcggcggctcccgccggtcgctcgccttcttcctcaacccgccgctggaccgcgtcgtccgcccgccgggcgcgctcctccaggagaacaagcaggcgggccgcccgcgcgcgttcccggacttcacgtggcgcgagttcctcgagttcacgcagaagcactaccggtcggacgcgggcaccatggacgccttcgtgtcgtggatcgcgggaggccgccgccaccatggcggacaggaggagggcaactga

SEQ ID NO: 6 - protein, 368 aa, Zea mays
MAAAAVVFDAEALSREEHIPAQFVWPTEERAPAGGVEEVAIPVVDLGEFLRRGVLPRGVAEACERHGVFQVVNHGVGAALLAEAYRCCDAFYALPLADKQRAQRRHGENHGYASSFTGRFHCCLPWKETLSFNCPAGAGTARAVVGYFVDVLGEDYRHMGEVYQEYCDAMTRLALDVTEVLAAALGLDRGALRGFFEGGDSVMRLNHYPACRQPHLTLGTGPHRDPTSLTLLHQDDVGGLQVRAGGGPWRAVRPRADAFVVNIGDTFAALTDGRHTSCLHRAVVTGGGSRRSLAFFLNPPLDRVVRPPGALLQENKQAGRPRAFPDFTWREFLEFTQKHYRSDAGTMDAFVSWIAGGRRHHGGQEEGN

SEQ ID NO: 7 - DNA, 1522 bp, Zea mays
gcacactcgcagctcgcacatctcatggtgtcctaagaacggcaagagccagctctgcctagcagcagcgcacagccacatccatggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaacgagccggccgtctctttcgccggggcccgcgcggggttcgcccacgtggtgatcaggtggcagacatgtggcccacgggccccgcgccgccttccccatttttggacgaccctactgctactactactagtgtacatatgcaaaaaaatacatatatatataggtactttctctaatatttttatatataagcaaggcggcctggtgttcttttctttgttttgtcgacaactgtttgatcccatcctatggacgatggatagttcaatgtttgtac

SEQ ID NO: 8 - DNA, 1161 bp, Zea mays
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaa

SEQ ID NO: 9 - protein, 386 aa, Zea mays
MDASPTPPLPLRAPTPSIDLPAGKDRADAAANKAAAVFDLRREPKIPEPFLWPHEEARPTSAAELEVPVVDVGVLRNGDGAGLRRAAAQVAAACATHGFFQVCGHGVDAALGRAALDGASDFFRLPLAEKQRARRVPGTVSGYTSAHADRFASKLPWKETLSFGFHDGAAAPVVVDYFTGTLGQDFEPVGRVYQRYCEEMKELSLTIMELLELSLGVERGYYREFFEDSRSIMRCNYYPPCPVPERTLGTGPHCDPTALTILLQDDVGGLEVLVDGEWRPVRPVPGAMVINIGDTFMALSNGRYKSCLHRAVVNRRQERQSLAFFLCPREDRVVRPPASAAPRQYPDFTWADLMRFTQRHYRADTRTLDAFTRWLSHGPAAAAPCT

SEQ ID NO: 10 - DNA, 1457 bp, Zea mays
taatcacctcatcacaggtccccccagcctcactctcgcgccggctcaaggtacattgcgtgtcctagccaagacacgcagctcatctcagcctcacacgcacagcaagagcgaggcgtgattcgccatgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgagcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggcagccgtggccgacggcgagcttgtgttcgataacaagtggccccaggatctaccgggcttcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtagaacaaataatgatgtgcgtgctgtgtgtaagcatggatatggatgtgaatatgtaatatgatgagcactcctactttggtatgtttgggaataacagacttgtgttggtctggttcattatttgtaagaaaatcaaaaagagttagtagggcaggaggctaaccacagtcatgctgcaccacatccctggtggaaagctggccgggttacgcta

SEQ ID NO: 11 - DNA, 1116 bp, Zea mays
atgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgagcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggcagccgtggccgacggcgagcttgtgttcgataacaagtggccccaggatctaccgggcttcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtag

SEQ ID NO: 12 - protein, 371 aa, Zea mays
MGGLTMDQAFVQAPEHRPKPIVTEATGIPLIDLSPLAASGGAVDALAAEVGAASRDWGFFVVVGHGVPAETVARATEAQRAFFALPAERKAAVRRNEAEPLGYYESEHTKNVRDWKEVYDLVPREPPPPAAVADGELVFDNKWPQDLPGFREALEEYAKAMEELAFKLLELIARSLKLRPDRLHGFFKDQTTFIRLNHYPPCPSPDLALGVGRHKDAGALTILYQDDVGGLDVRRRSDGEWVRVRPVPDSFIINVGDLIQVRERGAPGVGELGEGEVLHALLLQPGDLHHGGAGGGAGEQGRSAQVRRLQLGRLLQHQEEQQLQEAQRGEHSDRAFQEEPRPRLTTATARIHAIAMSSSDSEHAMSSLASW

SEQ ID NO: 13 - DNA, 1733 bp, Zea mays
atgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctagcgagccgggccaaggccgtctctttcgccccacgtgcgcgcccagctgggcaggtggccagacacgcggcccgcgggccccgcgccgccttgccattttttgacgctggccctactgctgtgctactagtgtacatatgcaagagtacatatatatatatatatatacgtattttctatatattatatataaaagcaaggcggcccggtgcccttctcttgttttgtccacaactgtttgatcccattattctatggaccatggatacttcaatgtttgtactaagaccgtgaacgtgggattcttttccttcctctgtgttttttctgagaaaaattaaa

SEQ ID NO: 14 - DNA, 1392 bp, Zea mays
atgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctag

SEQ ID NO: 15 - protein, 463 aa, Zea mays
MRPRLPPNVPSLPSSLSLLANSLSSPVTNTPTRPDSFPAYLQLAHLMVSQERQEPAVPSSSSSSAKRAATSMDASPAPPLLLRAPTPSPSIDLPAGKDKADAAASKAGAAVFDLRREPKIPAPFLWPQEEARPSSAAELEVPMVDVGVLRNGDRAGLRRAAAQVAAACATHGFFQVCGHGVDAALGRAALDGASDFFRLPLAEKQRARRVPGTVSGYTSAHADRFAAKLPWKETLSFGYHDGAASPVVVDYFVGTLGQDFEPMGWVYQRYCEEMKELSLTIMELLELSLGVELRGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRRARRSLAFFLCPREDRVVRPPASAAPRRYPDFTWADLMRFTQRHYRADTRTLDAFTRWLSHGPAQAAAPPCT

SEQ ID NO: 16 - DNA, 1510 bp, Zea mays
aaagagcgcgcgacggcggcccctgggagagccatgcgagactggaggcggaaccgcgcacgacaccaagctgccgcgccggactgctgcacgcaagcgcagcgcaggaccgaccgacctccgtaggcacgcacggcgccggcggcatggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcggcttcttccggctgccccccgaggagaaggccaagctctactccgacgaccccgccaggaagatccggctgtccaccagcttcaacgtgcgcaaggagacggtgcacaactggcgcgactacctccgcctgcactgccatcccctcgacgagttcctgcccgattggccgtccaacccgcccgatttcaaggagaccatgggcacctactgcaaggaggtccgggagctcgggttcaggctgtacgccgcgatctcggagagcctgggcctagaggcgagctacatgaaggaagcgctgggggagcaggagcagcacatggcggtcaacttctacccgccgtgcccggagccggagctcacctacggcctcccggcgcacaccgaccccaacgcgctcaccatcctgctcatggacccggacgtcgccggcctgcaggtgctccacgccggccagtgggtcgccgtcaacccgcagcccggcgcgctcatcatcaacatcggcgaccagctgcaggcgctgagcaacgggcagtaccggagcgtgtggcaccgcgcggtggtgaactcggaccgggagcgcatgtccgtggcgtcgttcctgtgcccgtgcaaccacgtcgtgctcggccccgcgcggaagctcgtcaccgaggacaccccggccgtgtacaggaactacacgtacgacaagtactacgccaagttctggagcaggaacctggaccaggagcactgcctcgagctcttcagaacctagcgaatcggatacggatggatggatacattacatacgcgccctctgtttttctccatgacgttagaagaacacgttctgcaatgtttgtccattcaaggtggtatcaatcaaggctgtggtcgttgcaattcttccgctccatatacatgattaaatgctttgaaagaaaaagaaaaaaaagaaacacaagtattatggcactactagtgtttttaggaacaaggaaagaggggttgcccctgctggctatatatattaaatataaataaaggtaaggctgtagacattggtgaataagagaaagtatttgagtttctctattgtcactccagaacagactcctttgcctcgat

SEQ ID NO: 17 - DNA, 1011 bp, Zea mays
atggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcggcttcttccggctgccccccgaggagaaggccaagctctactccgacgaccccgccaggaagatccggctgtccaccagcttcaacgtgcgcaaggagacggtgcacaactggcgcgactacctccgcctgcactgccatcccctcgacgagttcctgcccgattggccgtccaacccgcccgatttcaaggagaccatgggcacctactgcaaggaggtccgggagctcgggttcaggctgtacgccgcgatctcggagagcctgggcctagaggcgagctacatgaaggaagcgctgggggagcaggagcagcacatggcggtcaacttctacccgccgtgcccggagccggagctcacctacggcctcccggcgcacaccgaccccaacgcgctcaccatcctgctcatggacccggacgtcgccggcctgcaggtgctccacgccggccagtgggtcgccgtcaacccgcagcccggcgcgctcatcatcaacatcggcgaccagctgcaggcgctgagcaacgggcagtaccggagcgtgtggcaccgcgcggtggtgaactcggaccgggagcgcatgtccgtggcgtcgttcctgtgcccgtgcaaccacgtcgtgctcggccccgcgcggaagctcgtcaccgaggacaccccggccgtgtacaggaactacacgtacgacaagtactacgccaagttctggagcaggaacctggaccaggagcactgcctcgagctcttcagaacctag

SEQ ID NO: 18 - protein, 336 aa, Zea mays
MAEHLLSTAVHDTLPGSYVRPEPERPRLAEVVTGARIPVVDLGSPDRGAVVAAVGDACRSHGFFQVVNHGIHAALVAAVMAAGRGFFRLPPEEKAKLYSDDPARKIRLSTSFNVRKETVHNWRDYLRLHCHPLDEFLPDWPSNPPDFKETMGTYCKEVRELGFRLYAAISESLGLEASYMKEALGEQEQHMAVNFYPPCPEPELTYGLPAHTDPNALTILLMDPDVAGLQVLHAGQWVAVNPQPGALIINIGDQLQALSNGQYRSVWHRAVVNSDRERMSVASFLCPCNHVVLGPARKLVTEDTPAVYRNYTYDKYYAKFWSRNLDQEHCLELFRT

SEQ ID NO: 19 - DNA, 1387 bp, Zea mays
gttttctttttgaacgtaactgacagaagctatctgcctagctacggcgtgtcggttgcttgtctcaccaaagcagcgacatggaagcctgacagctcgtcgcgtcgcgccatttccacccaacaaagcggcggcgccagcacgcactgcttctgcttgtgcgtgctcctccgttccgggcacgcctctaaagtctatacagcctcgaatccatcccggccgccgctcctgggggatactacagcgagccgaagcggggatggcggagatccctgtgatcgacctgcgcgtcgccggctcggcggccgaggagtccgcgcggctgcgggccgcgtgcgagcgcctgggctgcttccgggtgaccggccacggcgtgccctcggtgctcctggcagagatgaaggccgccgtgcgcgcgctcttcgacctccccgacgacgccaagcgccgcaacgccgacgtcatcaccggcagcggctacgtcgcccccagcccgaccaacccgctctacgaggccttcgggctcctcgacgccgccgtgcccaccgacgtcgacgccttttgcgcgctcctcgacgcgccgcccaacatcagggagaccgtcaaggcctacgcggagaagatgcacgatgtgatcgttggcgtcgcccgcgagctggcgtctagcctggggctagtcgaggagcactcgttccaggactggccgtgccagttccgcatcaacaggtacaactacacgcgggagacggtgggctcctccggcgtgcagacccacacggactcgggcttcctcaccgtgctccatgaggacgagtgtgtcggcggcctcgaggtcctggacccgggcaccggcgagttcgtgcccgtggaccccgtcgcgggctcctttctcgtaaacatcggcgacgtcggcacggcgtggagcaacgggaggctgcacaacgtgaagcaccgggtgcggtgcgtcgcacccgtgccgcgcatctccatcgccatgttcctgctcgcacccaaggacgacagcgtgagcgcaccggcggcgttcgtggacgcggaccacccgcgcaggtacaaggtgttcaactacaacgactatcggaggctcagactgtccaccggcgagcacgcaggcgaggcgctcgcacggatggcggcgtgacgtggctggagctgcaaattggattggaagccgagacaagccgttagttatttaccatgcccgtgcgttcaccgcacacaatcatattcaaaagccataaaataaaaaataattttaatatcagtcaacatatggtttaaatatcatatggagtacaatattccgaatttttttttgtaatttagtctgtcttttgaaaaaaatgcacatctagacctccggatgact

SEQ ID NO: 20 - DNA, 900 bp, Zea mays
atggcggagatccctgtgatcgacctgcgcgtcgccggctcggcggccgaggagtccgcgcggctgcgggccgcgtgcgagcgcctgggctgcttccgggtgaccggccacggcgtgccctcggtgctcctggcagagatgaaggccgccgtgcgcgcgctcttcgacctccccgacgacgccaagcgccgcaacgccgacgtcatcaccggcagcggctacgtcgcccccagcccgaccaacccgctctacgaggccttcgggctcctcgacgccgccgtgcccaccgacgtcgacgccttttgcgcgctcctcgacgcgccgcccaacatcagggagaccgtcaaggcctacgcggagaagatgcacgatgtgatcgttggcgtcgcccgcgagctggcgtctagcctggggctagtcgaggagcactcgttccaggactggccgtgccagttccgcatcaacaggtacaactacacgcgggagacggtgggctcctccggcgtgcagacccacacggactcgggcttcctcaccgtgctccatgaggacgagtgtgtcggcggcctcgaggtcctggacccgggcaccggcgagttcgtgcccgtggaccccgtcgcgggctcctttctcgtaaacatcggcgacgtcggcacggcgtggagcaacgggaggctgcacaacgtgaagcaccgggtgcggtgcgtcgcacccgtgccgcgcatctccatcgccatgttcctgctcgcacccaaggacgacagcgtgagcgcaccggcggcgttcgtggacgcggaccacccgcgcaggtacaaggtgttcaactacaacgactatcggaggctcagactgtccaccggcgagcacgcaggcgaggcgctcgcacggatggcggcgtga

SEQ ID NO: 21 - protein, 299 aa, Zea mays
MAEIPVIDLRVAGSAAEESARLRAACERLGCFRVTGHGVPSVLLAEMKAAVRALFDLPDDAKRRNADVITGSGYVAPSPTNPLYEAFGLLDAAVPTDVDAFCALLDAPPNIRETVKAYAEKMHDVIVGVARELASSLGLVEEHSFQDWPCQFRINRYNYTRETVGSSGVQTHTDSGFLTVLHEDECVGGLEVLDPGTGEFVPVDPVAGSFLVNIGDVGTAWSNGRLHNVKHRVRCVAPVPRISIAMFLLAPKDDSVSAPAAFVDADHPRRYKVFNYNDYRRLRLSTGEHAGEALARMAA

SEQ ID NO: 22 - DNA, 1496 bp, Zea mays
gtcggtctcttgtctcaccaaaccggcgacatggtacatggaggccagcccgtcgcttggcgccacaagtctcggtgccgtccgtccgacaagcggcgccagcgcacgctggctgctcgtgcacgcctctaaatacggccccggacccgccaccaagcgaaggccaatcccgtccgccgccccccaccaaccacgaaccacgcaagcgaacccggccggcgcggggcagcggcgatggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcgcgcgcctcgacgcgccgcccaaagtcagggagaccgtcaagacctacgcggagaagatgcacgacgtgatcgtcggcgtcgccggcgagctggccaccagcctggggctgggcctggaggagcactcgttccaggactggccgtgccagttccgcatcaacaggtacaactacacgcaggagacggtgggctcctccggcgtgcagacccacacggactcgggcttcctcaccgtgctccaggaggacgagtgcgtcggcggcctcgaggtgctggaccccgccgccggtgagttcgtgcccgtggaccccgtcgccggctccttcctcgtcaacatcggcgacgtcggcacggcgtggagcaacgggaggctccacaacgtgaagcaccgggtgcggtgcgtcgcgcccgtgccgcgcatctccatcgccatgttcctgctggcgcccaaggacgaccgcgtgagcgccccggaggcgttggtcgacgcgggccacccgcgtcggtacaagccgttcaactacgacgactaccggaggctccggctgtccaccggcgagcgcgcaggcgaggcgctcgcgcggatggcggcgtgatgtcgtcacgcacgtgcaagccgttaattataggctcgcgcatgcatacgcctacacgagaggttgtctcgttaagccgttctattaaaatgtgtgggggagaaagatgactaccgtggtgccatgtggattgctatcgggtctgatcaataaaatcttgcaacacttgcacgtgcgattccatatcctagcacgggtgggcgccacgctagtaggtagagaccggagcggccaaaaaatggctacagcaccagtaggtgaactctcaagcaacactggctatcccacttctgacgttgtctctctcatcactatgtatgaccagcgaatgaagtgtttaaaaatctgacgccgtgaaa

SEQ ID NO: 23 - DNA, 903 bp, Zea mays
atggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcgcgcgcctcgacgcgccgcccaaagtcagggagaccgtcaagacctacgcggagaagatgcacgacgtgatcgtcggcgtcgccggcgagctggccaccagcctggggctgggcctggaggagcactcgttccaggactggccgtgccagttccgcatcaacaggtacaactacacgcaggagacggtgggctcctccggcgtgcagacccacacggactcgggcttcctcaccgtgctccaggaggacgagtgcgtcggcggcctcgaggtgctggaccccgccgccggtgagttcgtgcccgtggaccccgtcgccggctccttcctcgtcaacatcggcgacgtcggcacggcgtggagcaacgggaggctccacaacgtgaagcaccgggtgcggtgcgtcgcgcccgtgccgcgcatctccatcgccatgttcctgctggcgcccaaggacgaccgcgtgagcgccccggaggcgttggtcgacgcgggccacccgcgtcggtacaagccgttcaactacgacgactaccggaggctccggctgtccaccggcgagcgcgcaggcgaggcgctcgcgcggatggcggcgtga

SEQ ID NO: 24 - protein, 300 aa, Zea mays
MAEIPVIDLRLAGSSPDESARLRDACERLGCFRVTGHGAPAGLLADMKAAVRALFDLPDDAKRRNADVIPGSGYVAPCPANPLYEAFGLLDAAAPADVDAFCARLDAPPKVRETVKTYAEKMHDVIVGVAGELATSLGLGLEEHSFQDWPCQFRINRYNYTQETVGSSGVQTHTDSGFLTVLQEDECVGGLEVLDPAAGEFVPVDPVAGSFLVNIGDVGTAWSNGRLHNVKHRVRCVAPVPRISIAMFLLAPKDDRVSAPEALVDAGHPRRYKPFNYDDYRRLRLSTGERAGEALARMAA

SEQ ID NO: 25 - DNA, 1614 bp, Zea mays
accacacgaattgcacatctccacagctcacgattccaacactagctacatatatatgtagctttctaggctactatatacactcaccaccaagtgtgaagtgtgtatatatagtgacagctactgcaatatatacatacgcgtcacctatatattagccaagctagctatatgagcttggttgcggcgccaatggcgatcgtcgacgtggccaacgcccagctgcagcaagcagcagcagcagctgccaagaaagacgaggacggccatgagcagcaggagtcgtcctacgactacggcgcgctgatgaaaggcgtgaggcacctgtcggacagcggcattaccaggctgcccgacaggtacgtcctgcccgcgtccgaccgccccggcgtccttgccgtctcgtcgtccgtggcgggcagcggcagggtcaagctccctgtcgtcaacctcgccggcctccgcgacccctgccagcgcgccgccgtgctggccacgctcgacgccgcgtgccgggagtacggcttctttcaggtggtaaaccacgggttcgggagcgacgtgagcggcgggatgctggacgtggcgcagcgcttcttcgagctgccgctggccgagcgagcgcggcacatgtcggcggacgtgcgggcgccggtgcgctacggcaccagcttcaaccaggccaaggacgacgtgctctgctggcgcgacttcctcaagctcgtctgccagccgctgcaggcggtgctcccgtactggccccagcagccggcggacctcagggacgtggccaccaggtacgccacggcgagccaccggctgttcatggaggtcatggaggcggcgctggaggccctgggcatccccacggccggcggcgtgctcggggagctggcagcgtcgtcgtcgcacatgatgacggtgaactgctacccggcgtgcccgcagcctgagctcacgctggggatgccctcgcactcggactacggcctcttcacgttcgtcctgcaggaccacgtcgagggcctccaggtcatgcacgacggccgctggctcaccatcgaccccatcccgggatcgttcgtcgtcaacgtcggcgaccacctagagatctacagcaacgggcggtacaagagcgcgctgcaccgggtgcacgtgaactccacgcggccgcgcatctcggtggcgtcgttccacagcctgccggcggagcgagtgatcgggccggcgccggagctggtggacgacgaggccggcaacccgcggcggtacatggacaccgacttcgctaccttcctcgcctacctcgcatccgcggacggcaagaacaagaccttcctccagtcaaggaagctgcctgctgctgctcctccatgcctctagctaactagatagctgcttattaatctgacagaataaaattaatcagttcagcgcacaattccacaagcgaaaacaaacctggatttgttttaattagctctgcccttcattattacattcaagctagctcttggtcaacgcatgcacacaagcttgagcattgactggtcccttttcaatcggttgcattgtactccctccgtaccaaaattggttgtcgctatagtattt

SEQ ID NO: 26 - DNA, 1212 bp, Zea mays
atgagcttggttgcggcgccaatggcgatcgtcgacgtggccaacgcccagctgcagcaagcagcagcagcagctgccaagaaagacgaggacggccatgagcagcaggagtcgtcctacgactacggcgcgctgatgaaaggcgtgaggcacctgtcggacagcggcattaccaggctgcccgacaggtacgtcctgcccgcgtccgaccgccccggcgtccttgccgtctcgtcgtccgtggcgggcagcggcagggtcaagctccctgtcgtcaacctcgccggcctccgcgacccctgccagcgcgccgccgtgctggccacgctcgacgccgcgtgccgggagtacggcttctttcaggtggtaaaccacgggttcgggagcgacgtgagcggcgggatgctggacgtggcgcagcgcttcttcgagctgccgctggccgagcgagcgcggcacatgtcggcggacgtgcgggcgccggtgcgctacggcaccagcttcaaccaggccaaggacgacgtgctctgctggcgcgacttcctcaagctcgtctgccagccgctgcaggcggtgctcccgtactggccccagcagccggcggacctcagggacgtggccaccaggtacgccacggcgagccaccggctgttcatggaggtcatggaggcggcgctggaggccctgggcatccccacggccggcggcgtgctcggggagctggcagcgtcgtcgtcgcacatgatgacggtgaactgctacccggcgtgcccgcagcctgagctcacgctggggatgccctcgcactcggactacggcctcttcacgttcgtcctgcaggaccacgtcgagggcctccaggtcatgcacgacggccgctggctcaccatcgaccccatcccgggatcgttcgtcgtcaacgtcggcgaccacctagagatctacagcaacgggcggtacaagagcgcgctgcaccgggtgcacgtgaactccacgcggccgcgcatctcggtggcgtcgttccacagcctgccggcggagcgagtgatcgggccggcgccggagctggtggacgacgaggccggcaacccgcggcggtacatggacaccgacttcgctaccttcctcgcctacctcgcatccgcggacggcaagaacaagaccttcctccagtcaaggaagctgcctgctgctgctcctccatgcctctag

SEQ ID NO: 27 - protein, 403 aa, Zea mays
MSLVAAPMAIVDVANAQLQQAAAAAAKKDEDGHEQQESSYDYGALMKGVRHLSDSGITRLPDRYVLPASDRPGVLAVSSSVAGSGRVKLPVVNLAGLRDPCQRAAVLATLDAACREYGFFQVVNHGFGSDVSGGMLDVAQRFFELPLAERARHMSADVRAPVRYGTSFNQAKDDVLCWRDFLKLVCQPLQAVLPYWPQQPADLRDVATRYATASHRLFMEVMEAALEALGIPTAGGVLGELAASSSHMMTVNCYPACPQPELTLGMPSHSDYGLFTFVLQDHVEGLQVMHDGRWLTIDPIPGSFVVNVGDHLEIYSNGRYKSALHRVHVNSTRPRISVASFHSLPAERVIGPAPELVDDEAGNPRRYMDTDFATFLAYLASADGKNKTFLQSRKLPAAAPPCL

SEQ ID NO: 28 - DNA, 1863 bp, Zea mays
tgccaccataccactagtgcaaggtcctagatttacacttggtgctacaccttgcttcgcccccttccttccttccttccttccttccctccttccttggtctctaggcagctagcagtgtggtgctgctgccggccgcctattggccgcctgggactgggatccattaattactgcgcgcgcgcggctaaccaaccaatcccagcgtgcgtaatctattgcccacatgccgacgccgtcgcacctcaacaagaacccgcgctacctggacttccgggcggcgcggcgggtgccggagtcgcacgcctggccgggcctgcacgaccaccccgtcgtggacggcggcgcgccgggccccgacgccgtgccggtggtggacctgggcgccgcggacccggcgccggcgccggcggcggcggtggcccgcgccgccgagcaatggggcgcgttcctgctcacgggccacggcgtccccgcggacctgctggcgcgcgtggaggaccggatcgccaccatgttcgcgctgccggccgacgacaagatgcgcgccgtgcgcgggcccggcgacgcctgcggctacggctccccgcccatctcctccttcttctccaagtgcatgtggtccgagggctacaccttctcgccggcctccctccgcgccgacctccgcaagctctggcccaaggccggcgacgactacaccagcttctgtgatgtgatggaggagttccacaagcacatgcgcgccctcgcggacaagctgctggagctgttcctcatggcgctggggctcaccgacgagcaggccagcgccgtcgaggccgagcggaggatcgccgagacgatgaccgccaccatgcatctcaactggtacccgaggtgcccggacccgcggcgcgcgctggggctgatcgcgcacaccgactcgggcttcttcaccttcgtgatgcagagcctcgtgcccgggctgcagctcttccgccacgccccggaccggtgggtggcggtgccggccgtgccgggcgccttcgtcgtcaacgtgggcgacctcttccacatcctcaccaacggccggttccacagcgtgtaccaccgcgccgtcgtgaaccgggacctcgacaggatctcgctcggctacttcctcggcccgccgccgcacgccaaggtggcgccgctgcgcgaggccgtgccgcccggccgggcccccgcgtaccgcgccgtcacgtggcccgagtacatgggcgtccgcaagaaggccttcaccaccggcgcctccgcgctcaagatggtcgccctcgccgccgccgccgacctcgacgacgacggcgacgccgccgtcgtccatcagcagcagcagctagtcgtctcgtcgtagccgagaccgatcgccggagactgatgctgatgatgatgcatatatacatgagagaaatcgtcgagtagactagccgattgcaaaagcaaccccagctgccgaaacctggcatatcgatcccattctctgctgcgcacatgtatgcatgcatgcgcttcgtccgttcgactcgtgtgtgcttgcttgcttgcgcgtgcagcagaactaattccgttccgcagctagctgctctgctctgctctgctggaatgtaattaagtagtagtatatggtagtagagaaaagattagctaggcgatcgatatagatgacgggccggggaagaagacgaattaattaagatcgatcgacgacgacgagctgtgcgtggctggctgtgttcttctctagcctagttacagaggccggctgctgctgcttccaatcgggctgcttgtcgctactgacgatcgttagtggatccattaactaatctggaattctggatt

SEQ ID NO: 29 - DNA, 1149 bp, Zea mays
atgccgacgccgtcgcacctcaacaagaacccgcgctacctggacttccgggcggcgcggcgggtgccggagtcgcacgcctggccgggcctgcacgaccaccccgtcgtggacggcggcgcgccgggccccgacgccgtgccggtggtggacctgggcgccgcggacccggcgccggcgccggcggcggcggtggcccgcgccgccgagcaatggggcgcgttcctgctcacgggccacggcgtccccgcggacctgctggcgcgcgtggaggaccggatcgccaccatgttcgcgctgccggccgacgacaagatgcgcgccgtgcgcgggcccggcgacgcctgcggctacggctccccgcccatctcctccttcttctccaagtgcatgtggtccgagggctacaccttctcgccggcctccctccgcgccgacctccgcaagctctggcccaaggccggcgacgactacaccagcttctgtgatgtgatggaggagttccacaagcacatgcgcgccctcgcggacaagctgctggagctgttcctcatggcgctggggctcaccgacgagcaggccagcgccgtcgaggccgagcggaggatcgccgagacgatgaccgccaccatgcatctcaactggtacccgaggtgcccggacccgcggcgcgcgctggggctgatcgcgcacaccgactcgggcttcttcaccttcgtgatgcagagcctcgtgcccgggctgcagctcttccgccacgccccggaccggtgggtggcggtgccggccgtgccgggcgccttcgtcgtcaacgtgggcgacctcttccacatcctcaccaacggccggttccacagcgtgtaccaccgcgccgtcgtgaaccgggacctcgacaggatctcgctcggctacttcctcggcccgccgccgcacgccaaggtggcgccgctgcgcgaggccgtgccgcccggccgggcccccgcgtaccgcgccgtcacgtggcccgagtacatgggcgtccgcaagaaggccttcaccaccggcgcctccgcgctcaagatggtcgccctcgccgccgccgccgacctcgacgacgacggcgacgccgccgtcgtccatcagcagcagcagctagtcgtctcgtcgtag

SEQ ID NO: 30 - protein, 382 aa, Zea mays
MPTPSHLNKNPRYLDFRAARRVPESHAWPGLHDHPVVDGGAPGPDAVPVVDLGAADPAPAPAAAVARAAEQWGAFLLTGHGVPADLLARVEDRIATMFALPADDKMRAVRGPGDACGYGSPPISSFFSKCMWSEGYTFSPASLRADLRKLWPKAGDDYTSFCDVMEEFHKHMRALADKLLELFLMALGLTDEQASAVEAERRIAETMTATMHLNWYPRCPDPRRALGLIAHTDSGFFTFVMQSLVPGLQLFRHAPDRWVAVPAVPGAFVVNVGDLFHILTNGRFHSVYHRAVVNRDLDRISLGYFLGPPPHAKVAPLREAVPPGRAPAYRAVTWPEYMGVRKKAFTTGASALKMVALAAAADLDDDGDAAVVHQQQQLVVSS

SEQ ID NO: 31 - DNA, 1439 bp, Zea mays
gacctccattttgattatctctatcctgtacgtgccgagagtccttcaaagccgacgacgagacgacgatgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcccgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctgcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaagccctaaggaactactagctgaatccataaactaataaagaattcgtgaataagggcgttggaagactggacacaacacaagagagttgctatatatcgtatttctgaaatttaaggcaaatatcttagttaaaaaactggtatatttaaatagacaatatatatctaaaataaagatagttcaccatttttacggtcgaacaatgataaagttatatattgtctgaatagtaacaaattaaagatttccaggag

SEQ ID NO: 32 - DNA, 1116 bp, Zea mays
atgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcccgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctgcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaa

SEQ ID NO: 33 - protein, 371 aa, Zea mays
MQSSSSSASTPAAASGLVFDLGSAAGVPETHAWPGVNEYPSVESAGRDVVPVVDMGVACPDATRALARAADEWGVFLLVGHGVPREVAARAEEQVARLFVLPAPDKARAGRRPGEPTATGYGRPPLALRFSKLMWSEGYTFRAATVREEFRRVWPDGGDDYLRFCDVMEEYDREMRALGGRLLDLFFMALGLTDVQFATGETERRIRETWTATMHPILCPEPERAIGLTAHTDSGFITLIMQSPVPGLQLLRRGPDRWVTVPAPPGALIVMLGDLFQVLTNGRFRSPIHRAVVSRERERISVPYFLCPPEDMTVAPLASALLPGRKAVFRAVTWPEYMEVKHKVFGTDAPALEMLQLQVDEEEQGERAATT

SEQ ID NO: 34 - DNA, 8800 bp, Zea mays
taaatttgtgatccttgtgaagttgttatatcatgaattgtgaacttgttgcatttgtgatcttttgtcaactttgttgtattgtgaagtttgatatgtttaccgatcgtattttagatttcgatcgttaccggtgtattttccgcaccaaacttttgtttccgatgttttcgaaataccgatatcgtttccgtttctatagttacccttttcaattttatttccgattaaaaatatgaaaacggtaatggttttagtgtttatcgaccgttttcatctctaatcatccctgccggtgaagtttaatttttcccttggctaaagagatgcaagctgctgtaaaatacgttaaaacaggcaaggcagccccagcagccagcatcgcgtgcccgtctatgtacatcagtggatacgtagcatctctagtgagtaatataacgattgcatttggctggaggacgtatgttatataagtatgtcatttaccagttgcattagtatcttccctaactcctataataactctcttcgtggaatggacgtagacgtatgctatataagtattaaaaaatagttttttaagctggtgtcctcaattttgctattgttctcgtttttatctttagttgtgtcacaaatttaatccgtacaacaaatcaaaaataccatacccttcttatattaattttctaacataacatttgtttagatattttcagtcgtgaaaatacaattctaattctaacgtcgtagtatcaaatcaaaccatccagaatttgaccaagcttaattataaaaaatataaaatttatgatactgaatagatagcattagatttgttatataatatatttttataaaataccatttttatggtataaatattggtactcctttactttaaactatagatagttttgactaaggatgcaactagaattgcatcctcttttcactgcaccttcattagttttaatatttatttagatgggcccttgcaaactgtagatatcatctcttgcaacattctttctatagcaccacgaaaatgtattgcggctttgaaattataattgaattagttgtatcatttctttcaccgatgcgttaaattcaaaattaagtgttatatttcttcataatttgttaaatatatagaccctataatccaccattatttactataatagcatacattaacattggttttagcctacactacgacactcgaggcattgaattttcctctatcaaagaattatatgtgtagtagtattgttcttgacaaaaagggggattaaaattaaactaccaatattgatacttatcttatcacatccatgaatacaatcaacactcttacaaaagataagatacaagattaaaaagtaccatgataatacattaagattattagcaatgcattaaattaaataaatgtgcaagtgaatcatgattttagttttatctattttacttttaaaatatgatattctctgactacttctaagcataaatgtgattctaagtcatgaccgatcgtgcttattcagaaaaatgaaggagacacagatttctataaaaaaaggttgtcatgggactattgggtcaaccatcttattcatttgggaaaataagtttagaacacatcaacccattttagatgttgagtttggccctaatggtccattgaccttacttttgtgggttgacatagaccatctatcccaagttattgttgtgtcacattccctgatatcatgaatctatattttagctttccgttttcatatttttagtcgttacatattttttatccgcgtactagattaaaactctagttgttgcaatacattttgttcatttttttctatttcttctttactaacaacatattctagttcctagctacattcttaagtaccatagtgctataaacattttttatcctacattattccacttaagaaattgaattttctgcataaaaaaattatatgtccagtagtgttgtcttataaaagcataaagtgattaaaattaaaaccattattgatatcttatttttcaaaaaaaaatataagcttatagaaagtgaattaatttcatggtaaattaatatagtttaaattgaattattagtgttattactatgtttattatcaatgaaacatttttcatggttgatataacttagtgttacttattttagtattttttatataattctagttaacttttagtttttgatttaaaaaaacgagaattgtgtccttttgtggagtgagtataaagaaagtaatatctgttcatcataatttggttttttaaggtacgtgaaacttgctttatatttggactcaagctatgtctaaatacatagtaaaaaagcaatatttctagaaaagacaaaacatcttataatttagaatcaaggaaatatatagattttatgtgcagtgagaagccatttacaatggaacgttcaacgttgggccaatagatattttgcgatatgatgatgggcatatttttgcatggttgtccctccactagctatagtttgatgatacgatacgctgcacacaccattgggttgtaccatgttagtgtagcaacagtagaaacccaattgtggccgtgaaccatgataatactaggtagagtgctagctagaggtttcaggctattgatgcgtgaattaaactttctgttgtgttgcgaggaaacgagtattgtgaaatatttgaaacggttttttttgtgaaagatttgaaacggtatttttgttgtgaaataaagatcaaggctaaataaattcaaactaataaaacatattaattgacggcctgaagcccccgcccccatggccccatgccatagcatcaggtcccacatgacatgaggccgcgcctccctctatgttggctccctgccttcgccgttgtcgtcgctcccgaactccctctcctcccctgttacaaatacccccacccgcccggacagcttccctgcacactcgcagctcgcacatctcatggtgtcctaagaacggcaagagccagctctgcctagcagcagcgcacagccacatccatggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggtgagtaaagaagaagatggcgccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggtaacgaacgaaagcgccggctcctctgcttttcttggcctctttgtccctgccctgtgctgctgtgcatattcattcattcagttctctgtggggttttttttttgtttaatttttttttgggatcgtatccagtgcacaagggccacgccgtgcacaaatgcacaaaacgaaatctggccgtccattttccatccaacgacatgacggcgcggggggtttttcacaaaacagactcggcaagctacggaggttgcgggagggttcatctgcatatttacgacggccgttggatggaaaatggacggccagatttcgttttgtgtatttgtgcacggcgtggcccttgtgcactggatacgatcccatttttttttttgccccgaatcctagtggacctaactggacagattacagcacgcacacgtaggcatgtcatgtagcagcactgcagtcgggtgcagtccagtccagtcctgtccagccgcgacactgtagtacatagcgatgcaacggagacacgcgttggagttggttccatctcttctcggcggccgtgccgaggcttccgcggggaagctgcgacaacagaacggaccgccgggggtgggcaggcagcaagctccctgttggcttgtgccgttgcgcagcggcgggtaccggacaacgctttcggcggcgcgcggcctcgtcggcttcccctgtttttgatgccgcctctcggtgtccggggaccgggaggatcgatggggcccgtgccgtctgatccgccacgcgagcggtcctatgcgatgcgccgcacgagcgcgggggggccgtggaacagtacacagctgggtcactcactcactcatcccgctggttgtggctgcttggttgcaacttggctcggctgtctgtctgttgcccccgccgcgttttctagccgtttccgctttgctcgcggtttcgctggcgatccggcacgcggcgcccacacccggggctggccccttggccgagtgggtggcaggcacttgcatgcatccggccggtttcccgcgaccaagctggcccgccgcaacaatgagagtgagacgagactttgtgtcagtgtgtgtatgtacatgtatgtctgcgcgacagccctaccgtccgacacgatgattcttgtgcactgtactgtactgtactaactccccccaccccctccggtatgtaacgcatgccatatgcaggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaacgagccggccgtctctttcgccggggcccgcgcggggttcgcccacgtggtgatcaggtggcagacatgtggcccacgggccccgcgccgccttccccatttttggacgaccctactgctactactactagtgtacatatgcaaaaaaatacatatatatataggtactttctctaatatttttatatataagcaaggcggcctggtgttcttttctttgttttgtcgacaactgtttgatcccatcctatggacgatggatagttcaatgtttgtacgtacgtaactactctctatagactagaatgggctcatgaaactggaccgatcgacacggacgtcacgtgcgtctggtaccggtagtgcaacgggtgccgaatgtttgctgggcccggacgagaatcgcttctcctcgtcctcggtcctcaccctgaacgaacgaataaggaaaatgctgcaccgaaagctccagacgtttccgaattccaaattccaaaaccccaaatcttcttgcttcacatcagtcttacccggttcatctgtgacaaaaaaaaaatagtgctagtttaggaactcaggtcgagattgaaggcaattgtggaggaatttaccctataatccttatgagaatttgagttcccaaactaactgagttggagcattcaacatttccctaaattttgtgcacatgtttctttgctatttatctttggacatgggacgatgggagacgcagatttaggggacccttcaattcagaacttcaggtgcacaaaccgaggttggcttgcctgcattcttgtttcggacatgcccaactaggccactactcactaccttcatctgagataccaattgctgacctaaatgacaagtatacacttacatttcagtgatagctgcaacaaaaaaaaaaatcttaccgcattttatctctgcattctgcatgccgcatcctgaacattacgtatctttcccggtgctctgttgcgttctcacgcagttgatggcatgcagtcttgcgccaccgaatccagtgtactggtcgtggtgacttgtcgcacagacagcagcccggcagcaccaagcgtgtcactgtaaactgttgggcgttaaacaacaacttgcacaacagctcaaatatggcatatgctatccgacaaactgaacaaggtgcccaattgatctgaatgtacctgtgatttccagcactatcgtacagcaacgttgtcaaaacaagtggggtggggttggggacagattttttcgataaagaagcttttataaaaaataacaatgatacaaatcctgggttatagatgtacagaaagcacgaagcacgaaagtccagtccaaagcacgtttttttgcctggtactagcccgatccggccggcacgaataagcgggtcgagctcggacgggaagctaagcacgacggactagcccgacacgacccgtttacctctaatcccgttaaacccgcttttttgcactaaaccgtgcttaccgaaccgtttagcccgttttttggcctgatttttcgtgcttaacgggccaggctcggacaaggaaacaagcccgcgggcttagacgatccggcctggttttttaaccgtgcctagcgggtcgagcccaaaataggtcgggcttcactgggcccgagccgggcgacccgtttggccatctctaacctgagtacaacttccgacttctgcaaaatacatacagccaaataaaagaaaagtaaaaagatctaaaaaatctcagctagaaacaatcaatccgaagactagatcgcctcccataagtctggaaaaaagagaccatggccacttgcaccaagatgtgtgcattattctacggttacaccaaagatttttgttctttaagggctagtttgggaaccataattttcaaagggatttctattttcctaaggaaaattagttcatttttccataagaaattagaaatccattggaaaattgtggttctcaaactagccctaagcgtcgaaaagaaccatatgcatatctagagacaaaattcctctaatttctattcaggcttcagcacatatacttcacgtgcttgcgtcaagttccttgggccgccacatggacttatggacttctcgacgcagcgaaagccgtcgttgcccttggtgtagctaggtcatccgcacctcccactggccagtggccactgcagggacttggccatgggcttgtttggttcagcttttttctgaccagcttttctgaaaatctggctgtgtgaagaatctggctgtgagagaatctgagtatcattacgattacgtgtggatgaagataaagttgttcatagggctcaggatctagaaagtgacggattcctactattacaatgactcaaccgattatgtgtttatgttgattttggatgatttttgccccaacaaattttatagaagctggctgaaaagctgagcgtttggcagtccacaacagtttttggtggccagaagctgccagaagccgatacaaacagggtccatgctttccatttcgtttaccgtgtacgcggtgtccctcacaatcaatcagtttaccttgtggctccaacacacatcaacctcggcacaacaacactgtgaatcattttcggcggtccatattattttcgacggttcatccctggccgccgaaaattgtctgttattttcggcggcttgacctagccgtcgaaaataggctgctattttcggcggccaaatccgagccgccgaaaataaggcttttaaaaaccgtcggctccttcttcttctctgttctttctctcctctcccaaagcccgccgccgctcacccgccgctcgctcgccgggctgcccgccactccgccgtcgtcgtcgagccaccgcatcgagaggtaaattttttttgcgtgttttattccttattttcggcggttgatatttaggcgccgccaaaattagtgtatatttgtaattgtgtttgtttaattactatttgtaattagtattattgtttaattcgatttcattaatgtattagtggtatatgtgatttagggattaggggcatattgtatttaggcattaatttcatattaatatgtggtattattatattattggttttaatagtacattatattggtacgtagaatagttgcattattagtgtttgtggtacttagtttgacttgat

SEQ ID NO: 35 - DNA, 8859 bp, Zea mays
cctattttgtgtctaatactcttcttatattaattgtttggtcaaactttagataaatttgactaatgatgcaattaaaactgcatcacctttactaaggtactgctttatatgtttcgacaaaattttcaattattctctatgtgttttaatctttgcgctacacctccattgatttaaatactcatttattttaaaccataacttaaattatatcggatctttgcatcctttctatggcaccatacatgaatcgatattttggctgcaaatttttaatcatgttagttttagcattttttcatatccatgtgttaagtttgaatcatgtgttgtttttatataatttattgaaaatatagatcctaaacttcactaatacttacaacaatagcatcatcatgtgttttaatccacgccacaacactcaaggcattgaattttcttctaccaaagagttgtatgtgtgtattgttctttaaaaaatagagtgattataattaaactaccagtattcatatgtaaaatgtatagacatctaaaataaaatttgcaaaaaacattgttgcagactttcaatataattaagaatgggttttagggtcatgatatatggtttgttaaagaaacttgtttttttttgcaattgataaactataaaatacattttcactattgtgtgcatatgtacttggtatacatagtggcatatatcatttttgtttactttgaggtttgaattatctatgttaaaattggataacatagatacattggtgtgcgtcctttggcccatttacttgactgaggagcaatactataaagtaaaacatatttggatattttatcttaaactcctagcataatattgatttaattatgaacaaatatatgtttaggtgatagtttcatgggtggtaaactatataagaaggcttaccatgatctttgcaaactctaggctatgaaagagttccatgatttgtcttagaagcatagacaaaacagtgataatgatctaaatcacacttatggcactgatgaccatatatgcaaagctaaatgcatgttaagttgtattatatcatatgtttacaatgactatcgcatataacgaggaatacattgtctatatagatagctattactgtagtagtgccaaatgttggacaacatgaatcataatcttcaaacctagagaaattgtagtcagtcgtacacatatcgtctagtaagttgtctatactttttatttattgtatcaaattttattgttatcttgcttgcttgtttgtttgtaccatagacacaatatggtcaaaaagtggtcaatcgattcgaagaagattgcaattgacgagtgctaacagttgatccttttgttgtgcacgctagcggagtagcatgaaaagagtaaaatatgaaattagcgttctaaactgtttgtgctataggtacttcgtatttaatggagtgactaactataggaaggtgagagctcagaagtcagcaccctcacacagagttctagagttagtggtcatcgaaccacgacaaactacatgatgagcagaagaggcaacatcaagactatgatcaatagtttcgggtcaatgaatgacatcgtgatgagtatttatctaactatatagaacaacaacacatgatgttttaagtaagttcaactgatcttctattgctatctttaagtatttaacgtagcgaataatgttttatctatttcattcataaataatgttgtgacaaaaggggataaccatcacttttaccatgttctagataccacaaccatctccaccatcataatgggttcttcattggtgcttggacctcaaataatcatatctatagccaacttagctcaattctaataaaattaggcaacttggcttcattgtagcaaaaatagccaacttagctcaattttatctaaacttagctaatctagcacaacttagatcaatattaggaaaaactaatcaatctaatctagctcaactatagcgaaagatagatattgtagcataacttagtagatctatctcaaattttagcaaaaactaatcaatttagataaactctataaaattttaatcattatgacttatttccaactaattgtaacttgcatgatttttatgttccttctttataattagcaacacctaaagacacgaatgatgaggggtctaacgcattcattaaccagttgttaaataatactctaggtagatgataagaactctaattattctatgaatctaagctaaaagatgtttaatatttaagtattggtgtttattatgttatttagaacgattcatgttacttaaagatttgttatgatttttaaatatgattatgataatttatgtggtgtggattaacttgtgaacatatgtgatgtagatgaatatgtatgttgtggatggaaccatatgaatatatatacacactcatatactattcgttggtgtaggtaaagcttcatccatcggtaattactaaatggtcttcagtcattaccactaggtgaagcttcacacgaccgataattattgaagaacgctcattaatttccggtaatggcttattggccttcactagtcggtgaaaattagctatttttataccaataaaaattagctaatatatgtaaaccaggtctaatttttatgggcctcttaccgaccaaaattgattagattattgttacaatagttttagtcaaaagctagctatgctataaaaattttgaattaaagtgagtttcgtaataaaaattgcatacttttaaaataaaataattaaaaaacagtttttagaaatacaatcaaacaccttatgctataaaaaaattgtaatgtacctacaaatatataatactttactttaaaataggcctgtgccttctcggctctatatgggctgcctccaacgaagcgccatggccatgggctccactgtgtcgggtcccacatgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtaagtaaggtagtaagaaggagcgccggtttacatttaccgcacgtcggcgtgcggtcgagtcgggactcgggagacgtatgaacccccgtcccgtcccatgcatgtgtggcaggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggtaacgaaacgaaagcgctcgctcctctgttttccttggccgctcttgtcctgtgtgtatattcagttgagctctctctgtgctgttatttcccgaatcctagtggacctaaacgggcaggttattacagcacgcacacgtaggcatgtcatgtagctagtacatacatagcgatgccgatgcaaatgcaatagagacatgcgttcgagttggttcctatctcggcgggctacggcaggtacacgcggccgcggcgcgctctctctagtctatccgcggccgcgcccaggccgatcgaggcttccgggggagagttgcgacaagagaacggaccgagggggtcggctagcggtagcaagttccctgttggtttgtggcgttggagcgttgcggagaggcttgcgcggcggcggggacgtcgacggggacgtggcggggagacgatacgatgggtgccgggcagggcaacgctttcggcgggtggccgtgtccaggtgcgcgcggccttgtcggtttccccctctcggtgtccatggccgagaaatgggtcgacgaccgagaccgacgctcggtgcggcgcccatcccgtctgatccgccgcgccacgcgagcggccctatgcgatgccgcacgggcgcggagggccgtcgcgcggagtataatgtatagtatatagtacaaggttggttggagtcgggttgggttggatcgggtcaccggtacgtggtggctgctgttgcccccgccgtttccgcttgcacttttgtcgcggtttcgctggcgatccggcacgcggcgcccacaccacgccggggctccaaacagctcgggcccttggccgtgtgggtggcaggcacttgcacgcgtccggttgtcgcggcctggcccgccgccgggcgcaccgcaacaatgagacagcccgacacgatgattcttgtgcactgtgctaacccgcatgccatgcaggcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctagcgagccgggccaaggccgtctctttcgccccacgtgcgcgcccagctgggcaggtggccagacacgcggcccgcgggccccgcgccgccttgccattttttgacgctggccctactgctgtgctactagtgtacatatgcaagagtacatatatatatatatatatacgtattttctatatattatatataaaagcaaggcggcccggtgcccttctcttgttttgtccacaactgtttgatcccattattctatggaccatggatacttcaatgtttgtactaagaccgtgaacgtgggattcttttccttcctctgtgttttttctgagaaaaattaaactgatttctgtgaaatttctttgttttaacaagaaaacagaaaaattacatgaggaaaacgctccatttatttcaacaagaaaaaaatacatgaaacagaaggagaaaaaacgtgttcgttctatcattttcacacgagaaaaaaaaacatagaaaacagaaaaactccccgcgttcagatgagctcaagaaaatggaacgacacggacgtcacccgcgtcttgtagcagtgggcgcacgggtgccgaatgtttgctgggcccccaagagaatcgcttctcctcacgctgaatgaatgaatcaacgagggaaacgctgcaccctgagttccagacgtttccgaattccaaacgtttttgtggcgtgcgtccatggggcgcccccaaacttcggacgtttccggcgctccaacaaatcttctcgcttcacacgtcaccgtcgtcccggattcatttgcctcgtcgctccaccattcgctgctctcctctccacgtactcttaccctgacctttgggaaagaactgaacattcgagatgcacaacagttcaaatataacatatgcagcacaagatcgttcgactgctatccgacaagccaacaacgtgcccagtagaactgaatgtacctgtgatttccagcactaacttacagcaacgttgtgaaaaaacaaaaacgaaaacaaacggcagaaaaaacagatgtattgttctacagttacaccaaatattttctggtcctttcagcaccaacaagagccatacgcatatctagaagacaaaattcctctaatttcacccctacgtggtagcagttcctcctcaacacagttcacgtgctagcgtcgagttctttgggccgccacatcgacttctcgacgcagagcaggccctcgctgcccttggtgtaggtcatccgcacctcccactgcacggacttggccatgctctccagctcatttatcgtgtccgcggtgtccctcacgatcagcttgccctgtggcctcagtacacggtcgacctcggcgaaaactgcagccagtttgcatctgtaaacaggcaacacagatttttagtatctaaaacactgcaggcaaacgccacaggttttagtcgcaagaagcaataaaagcatgcaaacaatgctacgtgtacgtatcaaaggaacatgtcaaaactcgttgcatgaacgatcattgatgtttccttgctgaactagtcacatcagtctgcttcaacttctgggtttcactagtagatataccagaagggtagaataatgtgaagagcaagaaatacagacctctttctgagctttgagaacagatggtccgcgtgcagaaggtcatacgttcttgggtaagtgctgaaagactcgcaccagtcatggtacatgccaaacaaaccgcgctcgtagatgatgggcagcgtgtctggtgaatcgatcggcacgatattcatgacccagaccttttggtccctcagagctgcagcaaaactgccatgcaacaatgtaaagcattagtcaagaagaaggtgtacagtgcatttctccttgtcaacagtcttcagtaacaaaaaaaaagtgttatgcttgactgaatctttcaaagaaatatgcttgatgacttatggtggacaagttgcctgttatagtgttatgttttaattaactatgtgccagcttgggtaactagtagttatgtagtgtgatctgaattaccaaaatataaataaataaataaacatgcccaagaaactacgaaaaccatttacttaccctccatagacagctctcatgtccatgacatttctcactttggaccagtcaattcccatgccattcacatacgatttacttacaacccgtttccagtgggcattatctgcctcaaaatcttcatttgcaggctttccatagacaccaaccttggaaccatcaatccagaaaggggtcttctcaagcctttgcggccataactctggccattttgatcctcggacttttgagccaccaggcagtttgtgcatgcatgcttccaacggtacattcctgcaaatcaaaaggctgtgtaagcaaagcagagaagcacttttctccattgaaaatatactcttctcaaagaaccgaaaccataccaagcagcatctgcatcatcagattccttgcacaatggcgggctgttttcagatcttttctcatagcaaatattgtccattggtttctgatatatgaccataccaacttggtttaacttatccttagtcttgttgaccatcttccagcacatggactttgtcaaagtagacatggctgaaaagggtatgtggccacatgttatgttagaaataaaattcaattttgaacagttggtccatagcatgtattttgaacaaatgcaatccttctccatccatgaaagaagttgacccttcatacttaggattattcagtactttcactcatgtctgctgaatttgttctcttggtagttgctatacaagaaagggggaagtacagagtagctaaacttatacaagctatagtctgatatttgtatgaaacataaattttggtatggatgtcttattaaaatgggaggttgtataatatttttctagcctacctcaacttgcttgagactaaaaggctttgttgttgttgttgaggctgtatggtgctttgactttacaaatcaagttatcagctaccctacttatggatatacacctctcataaaatgatggtaagaagtttcgatatgtcacattaacataagaacttcattcagttagggtacaacgaagttaagtagttacggaaataccattccaaatctcaacatcctctgggagcttttggtaaacaggagtggcagaccagacaaagtaaccaccagggcgtaacaagcggttcaattccagcaaaagcatgccacctaaaagtagcgagccagcaataagattcagttctatagcaaatcaataaatgaaaggaggacatgtcaatatgtaaccagcaggacaaaccttcgatgtgccaaggga

SEQ ID NO: 36 - DNA, 1788 bp, Zea mays
aatcccagcgtgcgtaatctattgcccacatgccgacgccgtcgcacctcaacaagaacccgcgctacctggacttccgggcggcgcggcgggtgccggagtcgcacgcctggccgggcctgcacgaccaccccgtcgtggacggcggcgcgccgggccccgacgccgtgccggtggtggacctgggcgccgcggacccggcgccggcgccggcggcggcggtggcccgcgccgccgagcaatggggcgcgttcctgctcacgggccacggcgtccccgcggacctgctggcgcgcgtggaggaccggatcgccaccatgttcgcgctgccggccgacgacaagatgcgcgccgtgcgcgggcccggcgacgcctgcggctacggctccccgcccatctcctccttcttctccaagtgcatgtggtccgagggctacaccttctcgccggcctccctccgcgccgacctccgcaagctctggcccaaggccggcgacgactacaccagcttctggtacgttgcgttgcgtgcttgtgtgcgcgcacacctgccgaccgcggccacaccgtacgcaacccacgcgtacgtacgtgcgctagctacctgcttcgctcgcttcgctcctctcgcctcgccatgcatatgcacgtacggccgtacaggtacagcagcaggtcacacgcacgaacgcacgcacgcaccagcaccgatatgatacatcatcgacgtgtcgtccccccgtctaaggccatgcatgcatgcaagcacgcctagctagcccttttggcttgctagctgacgaggggagctaggacgagcatacttactgtgcgcgtcatgctcaattgctcacactatactactacttgttactacagtgatgtgatggaggagttccacaagcacatgcgcgccctcgcggacaagctgctggagctgttcctcatggcgctggggctcaccgacgagcaggccagcgccgtcgaggccgagcggaggatcgccgagacgatgaccgccaccatgcatctcaactggtgggtatatattattgtctgtcatgttgtcgtcgtcgtacgcgttgcggttgggtgtacatgtatataacacaaacaacaaaaaactaacgccgtgccgacgacgacgacgatcatcaggtacccgaggtgcccggacccgcggcgcgcgctggggctgatcgcgcacaccgactcgggcttcttcaccttcgtgatgcagagcctcgtgcccgggctgcagctcttccgccacgccccggaccggtgggtggcggtgccggccgtgccgggcgccttcgtcgtcaacgtgggcgacctcttccacatcctcaccaacggccggttccacagcgtgtaccaccgcgccgtcgtgaaccgggacctcgacaggatctcgctcggctacttcctcggcccgccgccgcacgccaaggtggcgccgctgcgcgaggccgtgccgcccggccgggcccccgcgtaccgcgccgtcacgtggcccgagtacatgggcgtccgcaagaaggccttcaccaccggcgcctccgcgctcaagatggtcgccctcgccgccgccgccgacctcgacgacgacggcgacgccgccgtcgtccatcagcagcagcagctagtcgtctcgtcgtagccgagaccgatcgccggagactgatgctgatgatgatgcatatatacatgagagaaatcgtcgagtagactagccgattgcaaaagcaaccccagctgccgaaacctggcatatcgatcccattc

SEQ ID NO: 37 - DNA, 1698 bp, Zea mays
cgtgccgagagtccttcaaagccgacgacgagacgacgatgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcccgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctggtacgtacgagcgccatgtcacgtgcttgtgctttcatgcctcgtaccgtcgtcgtgctgtacgtgttatgtttatcggccggtacgtcacgcgtgctacactggttaacgacgtgagcgtgcccacgttgactgcatgcatgtgcatgcgcgcgcccagcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtacgtacgtcaaaaacgaatatctgaccaatgcaaacgtttttctgcaatgccagtcatccactcatcctgtacgtacctctggactctgcttgtccatctactgatgacacgtatggtaggtaccccaggtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaagccctaaggaactactagctgaatccataaactaataaagaattcgtgaataagggcgttggaagactggacacaacacaagagagttgctatatatcgtatttctgaaatttaaggcaaatatcttagttaaaaaactggtatatttaaatagacaatatatatctaaaataaagatagttcaccatttttacggtcgaacaatgataaagttatatattgtctgaatagtaacaaattaaagatttccagg

SEQ ID NO: 38 - DNA, 4465 bp, Zea mays
cggtctaagtgaccgtttgagagaggaaaagggttgaaagagacccggtctttgtgaccacctcaacggggagtaggtttataagaaccgaacctcggtaaaacgaatcaccgtgtcatccgccttatttgcttgtgatttgttttcgccctctctttcggactcgtttatatttctaacgctaaccccgacttgtagttgtgcttaaagtttgtaaatttcagattcgccctattcaccccctctaggcgactttcatataaatattgggagaaatatgaaaaacaaatgaaggtcgaacgagtcagagacaccataaaaaagaggtcgtcttaactagggtgctaaacctcaacattgtagtagatcttagtactgagtttgacatctttgacaccaacaagatggtgatacgttactttctacgttaacttgggtaggtatatcgactatagtggcctataacactaggctatgtaatatgatattgtgttgagtctttataaacatgattttttttaaaaaaaagagctaaaataaaaaatagaaatcgacggtacgatgcaagttcttctcaagacaaccaaacgcacccttgcccctttattgaaattgaagtatgtgctttatcaaatgtttaaatactaattataagtattaaatataatttaattataatactaattatatagataaagactaaataacaagacaaatttattaaatataattaattcattattaacaaatacttaatgtagcacgatcgaatcatggactaattagtcttgatagactcgtcttaccatttaatcataattagttttgtatactgtttataatatttctaactagctagtattaaacttttgatgtaacctaactaaagtttagtcacgccaatacataaggactcggatcgttcgatcacccatgacatcacgtatactaagagcatctccaaaagctctccagaagtctcccctaaatctatttttttgggaaaaacacaaaaacatgtctccaacagttcccttaaagcgcccccaactttttcatagcccttaaaactccctcatttgtagctacaaatgaggggttttttgggctccccagaaacaaactgttgatttaagggatctgttggagaaaggattaaaatttaccctcacttattatttagatgtcccttaaaactgattttgaggagtcgttttatgtagagctcttggagatgctctaacacaccgagcacaaccgcatcatcaatcaaaacaacccaaagtttgttcggtacaagtcatcagcctgtgtacacacatcagcctcggccccgggagaagcgctagcaaacaaggttcacctaaaaatccatccagattcattgaatccaaccagcacaaacgtcccatttattaatcacctcatcacaggtccccccagcctcactctcgcgccggctcaaggtacattgcgtgtcctagccaagacacgcagctcatctcagcctcacacgcacagcaagagcgaggcgtgattcgccatgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgagcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggcagccgtggccgacggcgagcttgtgttcgataacaagtggccccaggatctaccgggcttcaggtgacgaaattaactatatatccctttcgatcatagttgcgttaataaattaagggaatcgtgagcgtacgtacgtaagtttccgcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgtgcccacctgatgaactgagctgaacgtaggttgcatgcactgcatgtgtataggcttctcagatcgcttcgtgtggcgtaaggtgtggagcaacgacaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtagaacaaataatgatgtgcgtgctgtgtgtaagcatggatatggatgtgaatatgtaatatgatgagcactcctactttggtatgtttgggaataacagacttgtgttggtctggttcattatttgtaagaaaatcaaaaagagttagtagggcaggaggctaaccacagtcatgctgcaccacatccctggtggaaagctggccgggttacgctacgctcgtgcagccagattactgcagggccgggatatgcttccggtggaaggaaggggacggtggctgaggaccatggggctggagcctgggagagaggtcgagctagaagaaagggggagagagaagacgcacaacgaagatgggtcagccagggatttcgacccaagggggagctagtggattttgggagaaaacagaaaagagaaaagagaaaagaagaaaaatttgttggtgtgaacacaaggttgatttgtcttttcttatttggattgatgatgagtcgtggactaaccgacccgtgagctattgtgtcgtataatcatgtctctcggtttctggtgtgcaggtttgaagcacagagacggtggtcgacgcaaaggtgaacgtcatgcaggttcgtgccgatggaccgggagcagtgaaagacgagcgttgggacttgaacaagggaccagagtcgccggatgactagccgcagtggctgacgcctggaacacgcatagacgtgaggacgtggtagagcaggtgaaaatcgcctagagggggggggggtgaatagacaaaacctaaaaattataaactttgaacacaaactttacctgaggttaccgttagaacgagtattaatgaaatcggagtgcggaaggcaagttcttcttgctacgagttgcttaatcaatattgataactttgggagtcaactcaaaatgatcacaagcaaaagaactagagagagaggagaggaagaatcaactcgcaaagtaatgatcaacacaaatgaacacaatgatttatttctcgaggtttggttccgaagaacctactccccgttcaggagtccacataggacatgtctctttcaaccctttctctctctcaaatggtcacatagactggttcagttgagagcacctagaggggggtgaataggtgatcttgtaaaatcaaacactaatagccacaaaacttagtttaaagtgttagtacggctaagtagctttgaagcgagttattgtgaacacaacaatcacagataaagcaacacaagagacacgcgatttttatcccgtggttcggctaagtaacacttgcctacttccacgttgtggcgtcccaatggacgagggttgcactcaacccctttcaagtgatccgatgatcaacttgaataccacggtctttttctttagagtgtgtttctcgtttgcgaggaatctccacaatttggagtctctcgcccttacaattgagatcacaaagaaaacatagagtaaggttggggagagcaacacacacgactcaaatccgcagcacaacaacacacacaagtgagaacgtgagcacacaaacacagcgtgaggagcttacaactcgaatagtgctcaaatctcaagaacg

SEQ ID NO: 39 - DNA, 21 bp, Artificial Sequence
  suppression oligo
ctccatcatgcggtgcaacta

SEQ ID NO: 40 - RNA, 21 nt, Artificial Sequence
  suppression oligo
uaguugcaccgcaugauggag

SEQ ID NO: 41 - DNA, 19 bp, Artificial Sequence
  suppression oligo
ggtactgcgaggagatgaa

SEQ ID NO: 42 - RNA, 21 nt, Artificial Sequence
  suppression oligo
uucaucuccucgcaguaccua

SEQ ID NO: 43 - DNA, 19 bp, Artificial Sequence
  suppression oligo
caggcgccatggtcatcaa

SEQ ID NO: 44 - RNA, 21 nt, Artificial Sequence
  suppression oligo
uugaugaccauggcgccugga

SEQ ID NO: 45 - DNA, 19 bp, Artificial Sequence
  suppression oligo
tcatgcggtgcaactacta

SEQ ID NO: 46 - RNA, 21 nt, Artificial Sequence
  suppression oligo
uaguaguugcaccgcaugaua

SEQ ID NO: 47 - DNA, 19 bp, Artificial Sequence
  suppression oligo
tcgctcgccttcttcctca

SEQ ID NO: 48 - RNA, 21 nt, Artificial Sequence
  suppression oligo
ugaggaagaaggcgagcgaca

SEQ ID NO: 49 - DNA, 19 bp, Artificial Sequence
  suppression oligo
tccaacgggcggtacaaga

SEQ ID NO: 50 - RNA, 21 nt, Artificial Sequence
  suppression oligo
ucuuguaccgcccguuggacc

SEQ ID NO: 51 - DNA, 19 bp, Artificial Sequence
  suppression oligo
gcatcaacaggtacaacta

SEQ ID NO: 52 - RNA, 21 nt, Artificial Sequence
  suppression oligo
uaguuguaccuguugaugcga

SEQ ID NO: 53 - DNA, 19 bp, Artificial Sequence
  suppression oligo
tggacgatggatagttcaa

SEQ ID NO: 54 - RNA, 21 nt, Artificial Sequence
  suppression oligo
uugaacuauccaucguccauc

SEQ ID NO: 55 - DNA, 19 bp, Artificial Sequence
  suppression oligo
tggaccatggatacttcaa

SEQ ID NO: 56 - RNA, 21 nt, Artificial Sequence
  suppression oligo
uugaaguauccaugguccauc

SEQ ID NO: 57 - DNA, 19 bp, Artificial Sequence
  suppression oligo
gcaaggtcctagatttaca

SEQ ID NO: 58 - RNA, 21 nt, Artificial Sequence
  suppression oligo
uguaaaucuaggaccuugcaa

SEQ ID NO: 59 - DNA, 19 bp, Artificial Sequence
  suppression oligo
cagagtacatggaggtcaa

SEQ ID NO: 60 - RNA, 21 nt, Artificial Sequence
  suppression oligo
uugaccuccauguacucugga

SEQ ID NO: 61 - DNA, 19 bp, Artificial Sequence
  suppression oligo
ccatgccctacttcttcaa

SEQ ID NO: 62 - RNA, 21 nt, Artificial Sequence
  suppression oligo
uugaagaaguagggcauggaa

SEQ ID NO: 63 - DNA, 19 bp, Artificial Sequence
  suppression oligo
acatggcggtcaacttcta

SEQ ID NO: 64 - RNA, 21 nt, Artificial Sequence
  suppression oligo
uagaaguugaccgccauguga

SEQ ID NO: 65 - DNA, 726 bp, Rice tungro bacilliform virus
tcctacaaaagggagtagtaatatttaatgagcttgaaggaggatatcaactctctccaaggtttattggagacctttatgctcatggttttattaaacaaataaacttcacaaccaaggttcctgaagggctaccgccaatcatagcggaaaaacttcaagactataagttccctggatcaaataccgtcttaatagaacgagagattcctcgctggaacttcaatgaaatgaaaagagaaacacagatgaggaccaacttatatatcttcaagaattatcgctgtttctatggctattcaccattaaggccatacgaacctataactcctgaagaatttgggtttgattactacagttgggaaaatatggttgatgaagacgaaggagaagttgtatacatctccaagtatactaagattatcaaagtcactaaagagcatgcatgggcttggccagaacatgatggagacacaatgtcctgcaccacatcaatagaagatgaatggatccatcgtatggacaatgcttaaagaagctttatcaaaagcaactttaagtacgaatcaataaagaaggaccagaagatataaagcgggaacatcttcacatgctaccacatggctagcatctttactttagcatctctattattgtaagagtgtataatgaccagtgtgcccctggactccagtatataaggagcaccagagtagtgtaatagat

SEQ ID NO: 66 - DNA, 165 bp, Rice tungro bacilliform virus
acgaatcaataaagaaggaccagaagatataaagctggaacatcttcacatgctaccacatggctagcatctttactttagcatctctattattgtaagagtgtataatgaccagtgtgcccctggactccagtatataaggagcaccagagtagtgtaatagat

SEQ ID NO: 67 - DNA, 2000 bp, Zea mays
ctgcaatatatacaccaaaagtattataaactgtcatatatatgaccaaaacctttttattttagaaaagtatattaatcatggtatattaatcaaagttgttgttggggctgcaaaaatcatacccttcttccacaagctgttccttgaactgcaggtactcaggaactctcagctcctcaacagcgagctcactgacgttgaccctcacatactcccagacaccaggcctagggcggatggcaagtgcaacccatggggggatgacaatcgcctcctgtaagataatagagctagaatgattaaagaaggtgcacactacaaaaggaacagtgctgtccagcgagatctgaatctgatgcaaacctgagctgccctcaggacatcctcaaaagcaccatccttgagcttctcgcgctcagcctcagggatcgcattgttgtactcggcaatgatctggtggggctgcagcataccctttccaaggtttttcagcctgcgcaaaacgatgtgccaaataacatcagactatgccagatctataaactcatcaaacatatacaatttcaagaaatagtttagacgtatgatcagcagtcagtagcgtgggaacatatgcaacatagcgaagaggcacaacagcaaattcattcgaaaaaatgaaaacaaagattcctctcttttaactgaacttctcgaaacccctttcatgcctacacatccgatctagtcagatgcctatgcgttcatgctgaacagaacgtgtcagaactaagcataaactggttagcaagcattatcgtattcgatagaccctttagtaacaagctatacattgggtaagttcagactccaatcattctgttcagaaacatcgtattgaatataaaactaaagaacacacatgcaggtgcagccagatctaacagcagtttacagtcggtactaaaaaaagcatggtgtatgtatgtatcatcagtatccagtactaggtttcgacaaaatcctggatgctaattaaatactcatcttattagggaacacaggaacattatgtctacagcattgaatgatggccacatcatgctagatctaacaatacataatatgatggaactggtcttaaaaagtcgcattcgctcaaataatacccgtagcaaaataaatgtaaacttgcagacgaagcgggggaaatgagggcagacctggtgaagacggcgacaagctcattggggtgggcagagagtgagtcgccaatgcgctccctgacgctgtggaggcggctcaggacacggtcacctgcaccttcccccattgctgtcctcttcctggatcctcaggcctgcacagcgaaaccgaaacggaagcggaagcttcagtcagcagagaaaactgaaaccgaaaaacggttcagatccgttgacataaaagctgcgatgacatcctaaaactaaaacccctccagcaagacataaacccaactgccaacaaccagtcttttaagtctcgacacacccttgacgctgcgccacgaaactatattgcaggcaagaaaccaacagaacctaactctggaaggggggaaagaaacggcagacaggagcaagacccaaaaaaaaacgactcagatcctggtactatagtcctagtacctagaccagaaagaagaaacaaccaatacaacaagaggcatacaagaactgaatcgatgaactgaaacgcttcagaggaccgaggaatggcggagaagggaggcgcctatttatacagatctgacgagagaaccgaacaaaaacacatcgatgggaaccatggagaagaaaagggctggccgcatggcaccaatggcctcggcctccaaaaagccgttgaatccaaagcaggcgaggacgaagcgtgacgcggcagggtacttctctagaaaagcacggcatcagcaaggtgggggggctggggttccttattgcaggcaatcacgaggtgattagcacaaacggaag

SEQ ID NO: 68 - DNA, 2000 bp, Oryza sativa
ctgaaatatacatcagagatattacaatgacatatatatcgataaaagaaaaataataaaattaagttttaaattttaagaatatatgtttttagtatcccaattatgcagatttcatacccttcttccacaagctgttccttgaactgcaagtactcggggactgtcagcaactcaacagcgagctcgctcacattgaccctcacatactcccagacaccgggcctcgggcggatggcaagggcaacccatggggagataacaatcccctcctgcatgataaaaaacaattacaagttaagttagagcaagcggtagagtaaagatggatctctgtgatgcaatgaaatctgaatctgattcaaacctgtgcactcctcaggacatcctcaaaagcaccgtccttcagcttctcacgatcagcctcagagattgcgttgttgtactcagcaatgatctggtgggcctgaagcattccctttccgaggttaaccagcctgcgcaaataacagtgtcaacaaaaatatcaggccagatctatcaactcagcctataaatatctcaataagataattttagcacttgagcatttgcgcataataagaaaatttgctattagccacttaaaaagaccatatatgatctgtttgcattgagatgaattaaaaatttcattgtagatatgaaatgattagttttgaccatttaattggacttaatgaaatatgcgcgataatcagatctacgcgctcgcgccaatagatctagtaagatgtaggttttttattttttttgtgaaactttgctaccacaacaagcatctgtaccagtgcagaattcattacttgtattcagtttgtaaaccgtatatataatataaataacatgcacatgcagtcagatctagcactaccagtccacagtaatccaaaactacatttgtatatttcatcattattcagtagtactaggtttgtacaaaatcttggctgcagaaggccgcacttaaatattcattctaatcagaaacttaaaaaaaaagtgactacaaaatgattgcatccaattcagtaaatatgagccattcctggccagatctaacaatctcaacaacaaagatcctatatgaacatctccttctaaaagaaaatacagtaacatctgaaggcagtagactagaaaccaacaaaatctaatgctgggaaatcactaaatcagcacgaacctggtgaagacggcgacgagctcattggggtgggcggagagggagtcgccgatgcgctccctgacgctgtggaggcggctcaggacgcggtcgccggcagcttcccccattgctctcctcttcctcttggctcctcaagcctgcgtgcacaaccaaccaccatcatcagatacatccagacccagtcaacacaatcactccaggaaaaaaaaaagtcaagccataaaccccaaccaaaaaccacgcctttgacaaacactggaagaaaaagaaaatcgcagctttttcacaagcaatctagaagaaaagaaaaagaaaagactacatagcagctataattgactgagaagcatacaggaatcaaacaatggagaaggggagggaggaagaacaatgatgctccaggctgaggaccgaggaactgggtgaagcggggtaggcgcgtatttatgcagatctgaggagagaaaccaccaaaacaatccgatggtttcaacgaaaaagatcgtcgcttcttgctgcaccagctcacccatagccgttgagatcgaagctaagctagcagcagcaaagctggaacgaagagtgacgcattcaagctcctctcctctcctctcctctcctccggagcacgaggccagcatgggatggattggggtttcttgttggccatggcaaaggaggaggtcattaacgttgacacggcgtaatttaattaaatcttatcttaaaatatgatttaagtggtagtaacaaggaagattaatactatgaa

SEQ ID NO: 69 - DNA, 2000 bp, Oryza sativa
gctgtttaagaaaaacagaagtaaaattcagtcactgttattttgcttcagttataatctgcaaatcgtcgttctggtacttactgtccatcaacaagctgttccttgaatgccaagtactcagaaacactcagctcttccactgccaactcacttacattcacccgaatgtagtcccagacaccaggccttggcctgatggccagtgcaacccagggcggcagcacaatggcttcctacatacagtcaaggaagtaagttagaaagactggtatttgactttgagttgactatcataaccatcctggctcattgccaaatttacctgagcagcccggagaatgtcttcaaagggagcatatttctctttgtcagcttcgatcaaggcatcgaactccgcaagcagctggtgacgctggagcattccctttccctggttaacatacctgcatagagtgatatttaagaaatagaaccaatgcttagatctcacatcctttctgcggctgaactatgttaatggcactaccacataaacctgatttttacttcttatttttaagaccacatgatctgtacttaatctagctatgaacaaacaatatttcaacatcatctaagattcatgactcaagacaaaaatgttagagctcatcacagattattatagataccatcattaaaactaaagagatgcataaccttgtcagctaagaatttgtaacatactaacatgttatcgtttcacatctgggttgactaagaactaaccaactgtatggataaaatcattgaaaactcaaaacaattagtagcaggttccaagaagacacaagatattatattgagatcttcacctagagaagagtgcaatcaactcattgggatgagacgagaaggtggcaccgaggcgttcgcggagactgtggaggcgagctagcttggcagccatgactcaatttcaggaactgcaaagaaaggttacacttagcaacacgtaccaaaaccactcacttgcacaagaataattagtcaacagccatcactaagcattgcaagactatctctgaacaggaaagccatgctaaatcaacactaataacatcacacaaaagcattggaagatcaaaacataactaaaaacagctgtttcatctacacaactgaaagcatctatggtttacgaagcagagtgcgagtactgattcaaaataaatcaacctgaaccaatatactctgacaatgttttcaaagggataaaagaaccagctttatcaaatggatttgttgggttttagtaagtatcattgagataccgatggcatatctcaaactttgcaaaattataatggcatggttccaaattaccctttagtattagcaccagttagatcctaattcctaaatccgataggacagagcgaaagatccctggagatatgaagatttggctacagattaagcagagccaacatgaagttccgaatattatgaatccgcaagcggggagatcaaagagaagaatacggaaggtcgcgactccatgaaagaatccaaccaaaaacccaaagatttttctcagttcaaaaaaaaaaaacccttcatttttggttcgccatccaccgacaggcaccaagacattcctcaggaagcaaaaaagattaagcagaacaagtgataagcaagacacagtatcaacggactacgagtcgagaaaatcactgaggcgcgattcttactgcaccaagtaaaaaaaaatttgggggcaaaaagaactctgcaatggggcggagcaacgtggcagcaaaactaaaggtcgaggatttgaggttttttgccggttttcctcgaaaccccgaatccgctcatagtaaacccactaaactgcagcagaaacccccctcttggttcagatttaccgaaagcagtaaacccaagaacatgtcagcaaaaactcctgcaagattcagctgacgacccaccaaagaatcgcaagaaat

SEQ ID NO: 70 - DNA, 2000 bp, Oryza sativa
tggcggacgcgccacgcacaaacacaaacctgcacacccctgtgtcagaggaggagaggccaagaaaggaaatcgagtggaggaagtgaggagcggcggagacgtaggaggaggagggggagatggaaatggaaagccgcgcgagagaggaggcgcgtgctggatgggaggaggaggaggaggtggtgggtttgtgtttggagagacgagcgagagaggcgaagcatttaaagggaggaagagggggagagagagagagagagagagagagagagagagagagagagaaaggaggaatataataaagggtggtgcacctgccaactgctatgctcaccaacactttgtacacacccagttacacccccctgcctttattatttccagtgcagtaataacttcaacaattattgaaatgaaaatggaattaatggagttagtatcggattagcgacacgcttgccgagcttctagacggtgcgattatttcagcgggaacgactttctgtaggtgaatttaatagaggagtgttttaaatccactcgacgttgtaatagctggtttaattcgtttgtactgtcgagtagttatccaaaatcaattttggatatttaaaagaaaaaaaaacagatccgaagtattggacctactggcaaataggaattttgctatatataggtgtgcgttcatttataatggagtagcatggagttttattaatccagtaaatgttttcattgatttaattaatataacgaatttcgcttgaggccatatttgttaaacgcttttatctctatcatcattcatcctaccagtaaagagcaccggagatcgcacttcatttaaatatatgtccatgttggataaaccatagtttattatagtgttcttttatatgttttgtggggaatttagattgtttaatatggcatacatatccatccatcattattatattctaacacaactggataagtgttctaaactattgtagaataactttgtagtatgatcgatcttgtggaataaaaaaagtctgacaataacctttcataaaggaatatgaatacccgtaatcaacgcatcaaatcattcacggtgtacgcctagcgaattcgttggcgagtgctcgtgcggccgtgggctcgctgtgatgcatgcatggctctctggctacgtcgagatagcgattagtagcaaaattaagcaagccacttattaattaatctttggagatatcatatgattaaggcattaattcgtacgtactcgtcgtcagcgttttctgcaaagtccactacagttttttctttctttgctgaaaatgctgatgtgttggagatggagtgacgtgcacaacctgccgccacgtggatggttgctggagcctacgtgtcatcttaatttgaacaaaaaaaaaagaggaataatacatcaatacattttcgaatttcagttctgccattgaccagtaatacacatgtcggcctcacattttaccctgatcttagtaacgggtggtcgcctggtcggtcactgaaaaaagttcaggaaattatagtcaaactgaaacgaacatattcactccttaaaaaaactaaatctttttatatatttgtgatattgtaaaatagctacgggataatgatatagatatatatagtgataagggatagatggatcgagatatggagttgtgctttctttaatttccactacttgggctaccatattatggtagttggtatgaaaagatacacagcagtatagtgatgtgatcaatgacatgtatatctcacatgctcccatgttggagtcaaattttgctagactaaaatccaattccaagcagtccctagccaagaacaaacaaaattcagtgaggtcactgctgcaccaaggactgcatgcatgcaggagaagggcattttctcttttttcttttggagactcgattcaattcggtcggtcggtcgcaatggtcagcttaattaaa

SEQ ID NO: 71 - DNA, 2000 bp, Oryza sativa
tgtgaaaggtggcggcaccagcttagccgcagcttctctcgtcgtctccctgaaacgagagggaggaagttggtagcgtgatatatttaggcatgtcatctcttgtataagaagtcttatctgtgctaattcacacggttctctaatctctctccattctgtttttgtaaattggttcagtagatagcgtagggttatgcttatatatactccgtgaagtatatatttaaaaattagtcacacgtaaagtactatacatgttttatcgtctaataacaataaaaacactaatcataaaatttttttaaataatacgaatggttaaacgttgaatatgaaccgtgcaaaactatatttattttgtaacagagaaaatatttcacattaattagattgttgttttatggaaggttggagagctgcgccgccgttgcgcagacctaggaggctgcttataagttataatcaatcaattcacggatgccggctgggacgcggcccatcgtccgggaagacgacaactcaacgcaaaaagccgatatgcctccaaattgccattgccacctctacggctgtttatactgctccaaatcaaaagcgtccatggaagaatctagtatttcccgcaaagacgatgatgatatgcaggattggatatatagggggttgttgcatgattgctagaactcccgtttccgaagttgttcgtccatttttaaagctgccaaataggaatttattttgttttcaagtgtaatagagttctgtccagatgagtgaattataatttggttcacattttatttgctaagtttcagtttgaacattctcaaataacttttttcttcactttttaaccgagtaacttagttattttttccgtttggaccacccaacaatttgttgctaagtgcatctcacccgtcaaataattcctttgaatccaaattcaattatatcccaaaaataaaaaacttctgaattccacatcaattcaaaccccaaccattttaatttctctccatattttccatttctctatttttacctttctcttttttccatctatttatttttttccttttctatttctttctttctccttcctttctctgtttccttcttcttctcctcggctaggcccgagccagcccgtgccgcctcgcgccaaccctgtgccgccttacgccgcgcttgcgtgcgctcgcgcccacctcgtgcccaacccgcgcacgccacacgcacacacgaggacgatcgacggacgaatgcaatcatatccccttccttactcagctagaaggctcaagaaccgcaactttgatctcttccaccctctcaaatccgccccaacccctgctgactcaatcgccattaccggaggaaaaatccccgaaaccctattaccggcgccactaacagagctccaaaattcgtcgcataattcgaaaatattctgaaattgaaggtaaaaatggaatctacatgcgaagtactccctttcccctccaatccgtcactggaacgccgccggcgccgcctcccgctgccactgccctgtttggccgccgacagccgcacggcgcgccgctgctccaggccgccctagcttcaaccaccgccacctttggctccgcctccctcctcttatgctcaccaagcccgcctccctcgccggagatcgccggaaccaccgccgccatggccgccaccgcctcctgcttctggccgccgccgccagcctcgccaccggcgcctatgccaccgccgaccacggaaacggagtccctacaccttggggaccacaaaaccggcggcatccctcccaaaaccggcctcctccaccgccggcgttcgtgggattccggccagttctgtgcagagcgagagaagaagaggaaaaatagattttcctattgaaagataaatcagaaaattcctttttcttttcctatcaagttgaccatccgtttgacctcaaaatcaaaatctgagaccta

SEQ ID NO: 72 - DNA, 786 bp, Zea mays
gacatggaggtggaaggcctgacgtagatagagaagatgctcttagctttcattgtctttcttttgtagtcatctgatttacctctctcgtttatacaactggttttttaaacactccttaacttttcaaattgtctctttctttaccctagactagataattttaatggtgattttgctaatgtggcgccatgttagatagaggtaaaatgaactagttaaaagctcagagtgataaatcaggctctcaaaaattcataaactgttttttaaatatccaaatatttttacatggaaaataataaaatttagtttagtattaaaaaattcagttgaatatagttttgtcttcaaaaattatgaaactgatcttaattatttttccttaaaaccgtgctctatctttgatgtctagtttgagacgattatataattttttttgtgcttaactacgacgagctgaagtacgtagaaatactagtggagtcgtgccgcgtgtgcctgtagccactcgtacgctacagcccaagcgctagagcccaagaggccggaggtggaaggcgtcgcggcactatagccactcgccgcaagagcccaagagaccggagctggaaggatgagggtctgggtgttcacgaattgcctggaggcaggaggctcgtcgtccggagccacaggcgtggagacgtccgggataaggtgagcagccgctgcgataggggcgcgtgtgaaccccgtcgcgccccacggatggtataagaataaaggcattccgcgtgcaggatt

SEQ ID NO: 73 - DNA, 1160 bp, Zea mays
atgtgctggtgccccataaggtaggcacctaggtctgtgtttgaagcatcgacagatttgtaaacatgttcctatgaacctatttctgattgataatttgtcaaaactcatcatttgtcttcatccttgcctgcttgcgttcacgtgacaaagtacgtgtatgtcttcggcctttgctgtgtatgtttcgcattgcttagatgtggtgaaagaacatcagaagatgcattgatggcgtgcttaaaccagtgatgtgctccaggtgttcctgcagtctgcagagatatttactcttgtagtcttgttgacagcacagttgtatgtgatttcttggatgtaatgtaaaccaaatgaaagataggaacagttcgtcctcttccgtatacgaaggtcactgtatcatttgtcgtggcacaagatgatctgcaggcaggactgcaacatggtttcttggactgtcctgaatgcccgttcttgttctttagttgagccagagcagcagcctggtgtcggtgcctgagacctgacgaagcacacggcaaacaaacaagtcgcagcagctagcaggggcgttgccatcgccacaagcccccaagagacccgccgaggaaaagaaaaaaaaactacggccgccgttgccaagccgagcgtgcgaaccgatccacggatgggagatcagagatcacccaccgcaggcgggcggcagtggctggcgaggtgcgtccacagaacctgctgcaggtccctgtccgtcccggcgaccccttttctaggcgagcaactccccatggcagagctgcacgcagcagggcccgtcgttggttgcagctttaaccctttttgttttaaccatacaatgcagagtcgcagaggtgaaacaggacggaaattacagaaaagatggtggtgtgccagcagccccagcatgaagaagatcaggacaaaagaaaagcttgtgattggtgacagcaacaggattggattggagccaagctaggcagtgagaggcaggcagcaagacgcgtcagccactgaaatccagagggcaacctcggcctcacaactcatatccccttgtgctgttgcgcgccgtggttagccaggtgtgctgcaggcctcctccttgtttatatatgggagatgctctcaccctctaaggt

SEQ ID NO: 74 - DNA, 1532 bp, Oryza sativa
tagtcctctaatatatgaaattttgatataggtaaagaagggtattgcaaggataagaatgtaaaaagaaataagagtaatccttaccgataatagtattccttctctaccgttaaaagttaaacctgtgcgtgtagcattttaatccaggatctatcgaatccgtccctcgttggcgtgggcgacgaacacgtgcagaagaagctttccccagaaagcacctcaccgcctcgccgtctggcagactggcacgcggggccctaccctcgctgcgcctgggcccgtccgccttctgcacactgtcacgcccccacccgctcgccgcctcgcgcctctctctccgcctccgccgcggccgcccgacgtgatagcgacacgtaggactcgccaaacacaaaaaatccatcgcgatttttggaattttgttacaaaccaaatcccgcattagagatttaatttgatttaatttaattacgtaggagtaccagataaggagatcgagttaaaaaagctaacggcgcggcgtggttatctccgaatcggctgtggctccccgcgtcggcgtcggcgcggcggcggcgcgccggccgaaccctggccgtcggatcgggcgtcgtcctgggccccacgcgccacgggcggctgtcgtttgctcctcggagcggggtgggcccaccatggccaccaccacaggtcgcggtcgcggctgacctggcggtggtcccgtgctcgcggtgttttttttttttcactctctttctctcggtggacagtagcgggggccgcggcccgcgggggcagagattgcaaaaacagcggaaacggaagattgcaaaattgcaactgctttcctgtttttaattcgggatcaaaaagattctttcgtcggggtccccgtgccattgttgtattgcgcgtaggtccttgcttgtaaaagataatctccttaattttttctttgtactactagtgtatatgcagtaagaatataccatgagtaaaatgaaccacaaaactaattacgatataccattctcatgtagacgttctcttttcttttgctagtcatacgtgcatatataaccaaacaaaaaaatgtttgaagtactcctatccaatttattactccagtagacaacaaaagaaaatgtttgaagtaataactgatccatggtacagtagggttgtcgtcaatcttgtgtttctttcattccattgtacttacaatcgtactccagctagcacagcacaatgggcttaagctttggaccccaaattctgatcttgtcggggacccgtacgaaaatactcccgtagagatgcagataccgtcacaacctacaaccaacgaatgttaagaaaacaaagggaaaaaaaaagaggcgaattcggaggagaaaaaacggtggctaaaatatagtgcgggtgtggggacgcgacgcgagcgacgaaagaggagagaggatgggttggcctgcccccccctcccctgtctataaatgcagaggcgccgagtgccctagtcgccgctc

SEQ ID NO: 75 - DNA, 841 bp, Oryza sativa
tcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccct

SEQ ID NO: 76 - DNA, 1392 bp, Oryza sativa
ctcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgattttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacaccccggcactatcaccgtgagttgtccgcaccaccgcacgtctcgcagccaaaaaaaaaaaaagaaagaaaaaaaagaaaaagaaaaaacagcaggtgggtccgggtcgtgggggccggaaaagcgaggaggatcgcgagcagcgacgaggccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcgtccctctcctctttctttctccgttttttttttccgtctcgtctcgatctttggccttggtagtttgggggcgagaggcggcttcgtcgcccagatcggtgcgcgggaggggcgggatctcgcggctgggtctcggcgtgcggccggatcctcgcggggaatggggctctcggatgtagatctgatccgccgttgttgggggagatgatggggcgtttaaaatttcgccatgctaaacaagatcaggaagaggggaaaagggcactatggtttatatttttatatatttctgctgctgctcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagatggctgacgccgaggata

SEQ ID NO: 77 - DNA, 743 bp, Oryza sativa
gaattcccggacctccatgcctacatcaactaatttgattccttgagtttacgtttagtgatatgtctatttttagagcttgttggggcttcggcctcagctctagccagccaaacatgttctaccaagtaccctatgttggcatgatatagtgatgcattataacaataaatgagcgagggattgctggctgaaaaagctatactagctgcatttggttatagttaaccgaactattaattgcgtgtacaacaaaataaaaaaaatgcatgttgcacattctttcattaacattatgttttggtagtgtgaattagaaatttgattgacagtagatcgacaaacatagtttcaatatgcttaagttagttatgactttaacatatcagtctccttgatattttcgttttagattcgtctctctactagtgtgtatgtccaccttccatagcagtgaagggttccattccatccctggtaaaaaaaaatcaaccactactatttatttcctaaaaagcaaaatgataaaatatcatttttttaataaaaataaaaaaattttggggtacataattgatgttgccccttgggattaaccttaaaaaagggcgaattttctagggtttggccaagttttgcaatgcaccaaattattccccttgggccggccgccaccccaaaaaaaaccccaacccccaactttccattgaaggccgggcccccttaaatcctcatccccccaa

SEQ ID NO: 78 - DNA, 144 bp, Oryza sativa
taaaaaagggcgaattttctagggtttggccaagttttgcaatgcaccaaattattccccttgggccggccgccaccccaaaaaaaaccccaacccccaactttccattgaaggccgggcccccttaaatcctcatccccccaa

SEQ ID NO: 79 - DNA, 612 bp, Cauliflower mosaic virus
ggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagg

SEQ ID NO: 80 - DNA, 837 bp, Coix lacryma-jobi
agcagactcgcattatcgatggagctctaccaaactggccctaggcattaacctaccatggatcacatcgtaaaaaaaaaaccctaccatggatcctatctgttttctttttgccctgaaagagtgaagtcatcatcatatttaccatggcgcgcgtaggagcgcttcgtcgaagacccataggggggcggtactcgcaccgtggttgtttcctgttatgtaatatcggatgggggagcagtcggctaggttggtcccatcggtactggtcgtcccctagtgcgctagatgcgcgatgtttgtcctcaaaaactcttttcttcttaataacaatcatacgcaaattttttgcgtattcgagaaaaaaagaagattctatctgttttttttttgaaatggctccaatttataggaggagcccgtttaacggcgtcgacaaatctaacggacaccaaccagcgaatgagcgaacccaccagcgccaagctagccaagcgaagcagacggccgagacgctgacacccttgccttggcgcggcatctccgtcgctggctcgctggctctggccccttcgcgagagttccggtccacctccacctgtgtcggtttccaactccgttccgccttcgcgtgggacttgttccgttcatccgttggcggcatccggaaattgcgtggcgtagagcacggggccctcctctcacacggcacggaaccgtcacgagctcacggcaccggcagcacggcggggattccttccccaccaccgctccttccctttcccttcctcgcccgccatcataaatagccacccctcccagcttccttcgccacat

SEQ ID NO: 81 - DNA, 947 bp, Oryza sativa
aatccgaaaagtttctgcaccgttttcacgtcctaactaacaatatagggaacgtgtgctaaatataaaatgagaccttatatatgtagcgctgataactagaactatgtaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagatatttttttttaaaaaaaaatagaatgaagatattctgaacgtatcggcaaagatttaaacatataattatataattttatagtttgtgcattcgttatatcgcacgtcattaaggacatgtcttactccatctcaatttttatttagtaattaaagacaattgacttatttttattatttatcttttttcgattagatgcaaggtacttacgcacacactttgtgctcatgtgcatgtgtgagtgcacctcctcaatacacgttcaactagcgacacatctccaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagag

SEQ ID NO: 82 - DNA, 721 bp, Mirabilis mosaic caulimovirus
tggagattcagaaaaatctccatcaacaaataatccaagtaaggattaatggattgatcaacatccttaccgctatgggtaagattgatgaaaagtcaaaaacaaaaatcaattatgcacaccagcatgtgttgatcaccagctattgtgggacaccaatttcgtccacagacatcaacatcttatcgtcctttgaagataagataataatgttgaagataagagtgggagccaccactaaaacattgctttgtcaaaagctaaaaaagatgatgcccgacagccacttgtgtgaagcatgtgaagccggtccctccactaagaaaattagtgaagcatcttccagtggtccctccactcacagctcaatcagtgagcaacaggacgaaggaaatgacgtaagccatgacgtctaatcccacaagaatttccttatataaggaacacaaatcagaaggaagagatcaatcgaaatcaaaatcggaatcgaaatcaaaatcggaatcgaaatctctcatctctctctaccttctctctaaaaaacacttagatgtgtgagtaatcacccacttggggttgtaatatgtagtagtaaataagggaaccttagggtataccattgttgtaatattattttcagtatcaataaaataatctttcagtttatcttatattcatttgtgtgacaccgtattcccataaaaccgatcctaatctctcc

SEQ ID NO: 83 - DNA, 352 bp, Peanut chlorotic streak caulimovirus
acagagggatttctctgaagatcatgtttgccagctatgcgaacaatcatcgggagatcttgagccaatcaaagaggagtgatgtagacctaaagcaataatggagccatgacgtaagggcttacgccattacgaaataattaaaggctgatgtgacctgtcggtctctcagaacctttactttttatatttggcgtgtatttttaaatttccacggcaatgacgatgtgacctgtgcatccgctttgcctataaataagttttagtttgtattgatcgacacgatcgagaagacacggccatttggacgatcatttgagagtctaaaagaacgagtcttgtaatatgtttt

SEQ ID NO: 84 - DNA, 1648 bp, Sorghum bicolor
cactcgcacatctcatggtgtcccaagaacggcaagagccagcactgcctctgcctagcaacagcagcagcgccaagcgagcagccgcgtccatggacgccagcagcccggccccgccgctcctcctccgcgcccccactcccagtcccagcattgacctccccgctgccgctggcaaggccgcggccgtgttcgacctgcggcgggagcccaagatcccggcgccattcctgtggccgcacgaggaggcgcgcccgacctcggccgcggagctggaggttccggtggtggacgtgggcgtgctgcgcaatggcgaccgcgcggggctgcggcgcgccgcggcgcaggtggcctcggcgtgcgcgacgcacgggttcttccaggtgtgcgggcacggcgtggacgcggccctggggcgcgccgcgctggacggcgccagcgacttcttccggctgccgctggccgacaagcagcgcgcccggcgcgtccccggcaccgtgtccgggtacacgagcgcgcacgccgaccggttcgcgtccaagctcccctggaaggagaccctgtccttcggcttccacgacggcgccgcgtcgcccgtcgtcgtggactacttcaccggcaccctcggccaagatttcgagccaatggggcgggtgtaccagaggtactgcgagaagatgaaggagctgtcgctgacgatcatggagctgctggagctgagcctgggcgtggagcgcggctactaccgggagttcttcgaggacagccgctccatcatgcggtgcaactactacccgccgtgcccggagccggagcgcacgctgggcacgggcccgcactgcgaccctacggcgctgaccatcctcctgcaggacgacgtcggcgggctggaggtgctggtggacggcgagtggcgccccgtccggcccgtcccaggcgccatggtcatcaacatcggcgacaccttcatggcgctgtcgaacgggcggtacaagagctgcctgcaccgcgcggtggtgaaccagcggcaggagcggcggtcgctggccttcttcctgtgcccgcgcgaggaccgggtggtgcggccgccggccagcagcgccacgccgcggcagtacccggacttcacctgggccgacctcatgcgcttcacgcagcgccactaccgcgccgacacccgcacgctggacgccttcacccgctggctctcccacggcccagtcccagcccaggaggcggcggctccctgcacctagcgagcgagcgagccgggccaaacaaacaaggggcaaaggccatctctttcgccggggcccgcgcgcggggttcgcccacgtgcgcgcccaggtgggcgctggccgcgggcaggtggcggacatgtggcctgcgggccccgcgccgccttcccatttttggacgctgccgcgcatgccgcatgcgtgcgtcgacggccctactacttctactactgctactgcgactactagtgtacatacgcaaaaatacatatatacgtattttctatatatatatatataagcaaggcggccccccggtgaccttttctttgtttttgtcgacaactgtgttttgatcccattctagctgttctatggaccatggatggttcgttcaatgtttgtacgta

SEQ ID NO: 85 - DNA, 1242 bp, Sorghum bicolor
atggtgtcccaagaacggcaagagccagcactgcctctgcctagcaacagcagcagcgccaagcgagcagccgcgtccatggacgccagcagcccggccccgccgctcctcctccgcgcccccactcccagtcccagcattgacctccccgctgccgctggcaaggccgcggccgtgttcgacctgcggcgggagcccaagatcccggcgccattcctgtggccgcacgaggaggcgcgcccgacctcggccgcggagctggaggttccggtggtggacgtgggcgtgctgcgcaatggcgaccgcgcggggctgcggcgcgccgcggcgcaggtggcctcggcgtgcgcgacgcacgggttcttccaggtgtgcgggcacggcgtggacgcggccctggggcgcgccgcgctggacggcgccagcgacttcttccggctgccgctggccgacaagcagcgcgcccggcgcgtccccggcaccgtgtccgggtacacgagcgcgcacgccgaccggttcgcgtccaagctcccctggaaggagaccctgtccttcggcttccacgacggcgccgcgtcgcccgtcgtcgtggactacttcaccggcaccctcggccaagatttcgagccaatggggcgggtgtaccagaggtactgcgagaagatgaaggagctgtcgctgacgatcatggagctgctggagctgagcctgggcgtggagcgcggctactaccgggagttcttcgaggacagccgctccatcatgcggtgcaactactacccgccgtgcccggagccggagcgcacgctgggcacgggcccgcactgcgaccctacggcgctgaccatcctcctgcaggacgacgtcggcgggctggaggtgctggtggacggcgagtggcgccccgtccggcccgtcccaggcgccatggtcatcaacatcggcgacaccttcatggcgctgtcgaacgggcggtacaagagctgcctgcaccgcgcggtggtgaaccagcggcaggagcggcggtcgctggccttcttcctgtgcccgcgcgaggaccgggtggtgcggccgccggccagcagcgccacgccgcggcagtacccggacttcacctgggccgacctcatgcgcttcacgcagcgccactaccgcgccgacacccgcacgctggacgccttcacccgctggctctcccacggcccagtcccagcccaggaggcggcggctccctgcacctag

SEQ ID NO: 86 - protein, 413 aa, Sorghum bicolor
MVSQERQEPALPLPSNSSSAKRAAASMDASSPAPPLLLRAPTPSPSIDLPAAAGKAAAVFDLRREPKIPAPFLWPHEEARPTSAAELEVPVVDVGVLRNGDRAGLRRAAAQVASACATHGFFQVCGHGVDAALGRAALDGASDFFRLPLADKQRARRVPGTVSGYTSAHADRFASKLPWKETLSFGFHDGAASPVVVDYFTGTLGQDFEPMGRVYQRYCEKMKELSLTIMELLELSLGVERGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRQERRSLAFFLCPREDRVVRPPASSATPRQYPDFTWADLMRFTQRHYRADTRTLDAFTRWLSHGPVPAQEAAAPCT

SEQ ID NO: 87 - DNA, 12906 bp, Sorghum bicolor
cactcgcacatctcatggtgtcccaagaacggcaagagccagcactgcctctgcctagcaacagcagcagcgccaagcgagcagccgcgtccatggacgccagcagcccggccccgccgctcctcctccgcgcccccactcccagtcccagcattgacctccccgctgccgctggcaaggccgcggccgtgttcgacctgcggcgggagcccaagatcccggcgccattcctgtggccgcacgaggaggcgcgcccgacctcggccgcggagctggaggttccggtggtggacgtgggcgtgctgcgcaatggcgaccgcgcggggctgcggcgcgccgcggcgcaggtggcctcggcgtgcgcgacgcacgggttcttccaggtgtgcgggcacggcgtggacgcggccctggggcgcgccgcgctggacggcgccagcgacttcttccggctgccgctggccgacaagcagcgcgcccggcgcgtccccggcaccgtgtccgggtacacgagcgcgcacgccgaccggttcgcgtccaagctcccctggaaggagaccctgtccttcggcttccacgacggcgccgcgtcgcccgtcgtcgtggactacttcaccggcaccctcggccaagatttcgagccaatggggtaagcgaagcaccgatttacatttaccgcgcgtcggcccctgaggcctgggtcttagtcttagcactgcatatacggtcggtagctctggatatgatacgtatatatgaaaccccgttccaatcccatgcacggtgtacacaggcgggtgtaccagaggtactgcgagaagatgaaggagctgtcgctgacgatcatggagctgctggagctgagcctgggcgtggagcgcggctactaccgggagttcttcgaggacagccgctccatcatgcggtgcaactactacccgccgtgcccggagccggagcgcacgctgggcacgggcccgcactgcgaccctacggcgctgaccatcctcctgcaggacgacgtcggcgggctggaggtgctggtggacggcgagtggcgccccgtccggcccgtcccaggcgccatggtcatcaacatcggcgacaccttcatggtaacccctgctctgttttttcttgtcctcctcttgtcctgtgtgtgtgtatattcacttctctctgtttttttgccccgaatcctagtggacctaactggacggattacagcacgcacacgtaggcatgtcatgtagcagcagtctgcagcactgtagtacttagcgatgcaatagagacatgcgttccagtcggttccatctcggtgggctacagctacagtcctacacggacgcggctcgtagtcgtagggacgggcgcgttctctgtatccacacacggctgcgcccaggccgaggcttccgccgcgggaaagttgcgacaacagaacggggtttgtgccgttggagcgttgcggagaggcagaggcttggggggacgggggcgcgatacgctgcgatgggtgggtgaccgaggcgacgctttcggcgggggcccgggcctgcccaggtgcgcgcggcctcgtcgccttcccctgtttttttgatgccgccgctcggtcctcggtgttctggctccgcccgcccgctcgctgggtgcccatcccatctgatccgatccgctccgctccgcggtggcggtcctatgcgatgccgccgcacgagcgcggggggccgcccgtggaggagtagaaagtggtacaaggttggttggaacttggaattgtggggggttactgctgctggtggctgctgctttgcaacttgccaggctgctgcctgttgccccccgcgttttctagccgtttccgctcgcgatccggcacgcggcgcccacaccggggctccagctcggccccttggccgtgtaggtagcaggcacttgcatctgtccgttcgacacgatgattcttgtgcactgtgtacgtatgtactaaccctttctggtatgatgtacgcatggcatgcaggcgctgtcgaacgggcggtacaagagctgcctgcaccgcgcggtggtgaaccagcggcaggagcggcggtcgctggccttcttcctgtgcccgcgcgaggaccgggtggtgcggccgccggccagcagcgccacgccgcggcagtacccggacttcacctgggccgacctcatgcgcttcacgcagcgccactaccgcgccgacacccgcacgctggacgccttcacccgctggctctcccacggcccagtcccagcccaggaggcggcggctccctgcacctagcgagcgagcgagccgggccaaacaaacaaggggcaaaggccatctctttcgccggggcccgcgcgcggggttcgcccacgtgcgcgcccaggtgggcgctggccgcgggcaggtggcggacatgtggcctgcgggccccgcgccgccttcccatttttggacgctgccgcgcatgccgcatgcgtgcgtcgacggccctactacttctactactgctactgcgactactagtgtacatacgcaaaaatacatatatacgtattttctatatatatatatataagcaaggcggccccccggtgaccttttctttgtttttgtcgacaactgtgttttgatcccattctagctgttctatggaccatggatggttcgttcaatgtttgtacgtactccacgtaaccaaactactctagtggactagtagatcgggctcatgtgatgaaactggaccgacgcggacgtcacgtgcgtcacccgcgtctggtagcggtagcgcacgagcgccgaatgtttcctgggcccgcaagagaatcgcttctcatctcctctcaccatgaatggggaaaaatgctgcgtcgaaagttccagacgtttccaaattccaaacggttttgtggcgtccgatccatggggcgccccaaacttccaagacgttttcaggttccaaatcttcgtgctccacatcaccttcttcccagattcatttgcctcgtcgcttgctctcctgtgttattcacgggtcccactgttgccccgtctgcgagaaagaaatttattagagttgaagcattcgacatttcgactgactgattgttagtatcactaaattttgtgcacatgtttctttggtcattcatctctggatattttttttagataatggatataaatatcgggcctctacatctgaggaagtacacagccaattattttcatctctggacatgggacgatggaagaggcagatagatttaggagacccttcaattcagaatttcaggtgcacaaggcctgcctggcttgcccggattcttgtttcggacatgaccaactaggccgcactacttgcactgatagctggagaaaaaacaaaactttgcaaacagcaggattatctacaagggaaactccatccacgtgaaccagcatttcagggagagatgcgacaaaaaaaaagaggcggcaacaaaaaaatcttactgcaattttatctctgcattgaacctcttccaaccatgccgcatcctgtactgttttgtatctttcccggtggtccgttgcgttctcacgcagttgataacatgcagtcacgcaccaccgaatccagtgtactaggggtagtgacttgtcacgcggaacaacaggtcggtagcaccaagcaagtcgctgtagacttgggcgtttaacaacgacttgcacaacagttcaaatatagcatatgcaattatgcacaagattgttcgactgctatccgacaaactgaagaagctgcccaattgaacagaatgtaccagtgatttccagcacactatcttacagcagcgttgagaatgaaacaacaaatgggggaaaacagatgtgtattattctacagttacaccaaagagtttgtcctttcagcatcaacaagaatcatatgcatatctagtgacaaaaattcctctaattttaccctacttggtaacagttctcttcaacacatatatttcacgtgcttgcatcgagttccttgggccgccacatcgacttctcgacgcaaagcaagccctcgttgcccttggtgtaggtcattcgcacctcccactgcagggacttggccatgctttccagttcgtttattgtgtccgcagtgtccctcacaatcagtttgccttggggcctcagtacacgatcaacctcggcaaaaactgccatcaatttgcatctgtaaacaagcaacacagatttagcatctgtaaacaccacaggtttcattgcaagaagcataaagcatgcaaacatgctacttgtacatgtcaaagaaacatgtcaaactcaaacacatgaaaatcattattattgttttcttgctgaactgatcacattagttggtttcaatttctgagttccactagtaatctataccagaaggatagaataatgtcaagaacaagagatacaaacctctttgtgagctttgagaatagatggtccgcgtgcagaaggtcataagttcttgggtaagtgctcaaagactcgcaccagtcatggtacataccaaacaaaccacgctcgtaaatgatgggcagtgtgtctggtgaatcaatcggcacaatattcatgacccagaccttttggtccctcagagctgcagcaaaactgccatgcaacgatgtaaagcattagtaaaaatattgggttttttaaaccaaaaccaagaaagataattcctccagcttaactgaaagaaagaaagaaaaaaactgcttaatgacttatggtggacaagttgcctgttatgttttatgatagctatgtgccagcttggctaactggtagttatgtagtgtgatctgaattaccaaaaaagagaagaaaaaaaaatcatgcccaagaaactgagaaagacacccatttacttaccctccatacacagctctcatgtccattacatttctcactttggaccagtcaattcccatgccattcacatacgatttacttacaacccttttccagtgagcattatctgcctcgaaatcttcatttgcaggctttccatagaccccaaccttggaaccatcaatccagaaaggagtcttctcaagcctttgtggccaaaactctggccattttgaccctcgaactttcgagccaacaggcagtttgtgcatgcatgcttccaaaggtacattcctgcaaatcaaaagattgtgtaagcaaagcagaggaagcacttcgccgcattgaaaatacgttcttctcaaagaaacaaaaccataccaagctgcatctgcatcatcagattccttgcacaatggtgggttgttttcggatcttttctcatagcaaatgttgtccattggtttctgaaatatgaccataccaacttgatttaacttatccttagtcttgttgaccatcttccagcacatggactttgtcaaagtggacatcgctgaaaagattaaggggtcatatgttatgatagaaataaaattcaattttgcactgttggtacatagcatctgttttgaacaaatgcaatccttccttatccatgaaagaagttaacccctgatacttaggattattcagtactttcactcatgaactgctgaatttgttctgccagtagttgctatactagaaatgttcagtgtaccaaacataaatttggtacgggttccttattaaagatgggaggctgtatggtatttcgacgtaacaaatcaagttagcagctaccctacttatggatatacacttctcaaaatgaatatacatagttttgataggtgacattaattaatataagaacttcatgcagttagggtgaaactaaactaagcagttacggaaataccattccaaatctcaacatcctctgggagcttttggtaaacaggagtggcagaccagacaaagtaaccaccagggcgtaacaagcggttcaattccagcaaaagcatgccacctaaaaggagtcagtaataagattcagttctatagcaaatcaataaatgaaaggaagacatgtcaccaacaagacaaaccttcaatgtgccaagggaccctgcagcgagcgcaatgaatgacatcaaagactctgctggggtatggaagtctcttggtgcccatcacagctgatattgctggaattcccctttctaatgcaaattgtacttgagcttcatgctcatctttcggagcaaaagacatggtaagcacatctctatcaaacatgtagcctccaaagctggcaactccacaaccgacatctagaatgacgcggcttcgtttgccccatgcaatatcaggcagtgcctgtgaatgacagtttaatcagcatatgatgaaagcaagtgtgataatatcaagttcaaagatgcaacatgaaactttcataatcatggacagtactaagcttgcttgatagattaatgtatggatgagactaaaaaaaaggaaagttgtatccatcagaacgagaggctgaaaacacatggctggctgtgaaagcctgatgtcgtttagtctagcataaacaaactgtcctcagcatgtagatttccatagggtggcatttgacaaattatgattgtggactagcgaatcaatcactgattctcaaaagtgtgagacagatgagttcaagtctaaggggtgactaatatgggatgctgggatgatgatgatgatatatacctgctgaatagtatcaatatagtggagggcaccattcttgaactgagtcccacccccagggaacaggaggtagtcacctgatactttaacccaattttgatgtcccttgtactctgcgagcctagtgtgaggaacattgctgtaccatacctgcaaaaagcagcacaagatggtaataagtaaacagagatcttggtcagctaaagatgattcagtgtcgtacaatttagaatagacagaatcaccttgtccctgctccttggccactcaattgggcgtttatatccttctgggagtggaacaaggcaggtaggaggctcctcagggcaatgcctctcacgatgttcataatgtttagtagttcgaagcttcttgatagccttctcgttgtcaaggcaaggtatgtaatctgtcgaggcactgctattacatagtttccaggaatagctagtcgcatcacctgaagactttgatgacgcttggacttccttttcattcttggactctgcagcctgtgtggggaatgaaccattctgggtatttgactccttcagaagctctgattgggccccatcaggaaatacctcgttggagtttgagctctgatccttctctccattttcttccaccttctcttctatctgaggttgctcctcctgagtggcatcaccttcaggcttctcttcttgatcatccttgctctctccatcaggtttttcatcaccactctcatttgtgatttcatcatctttcttctccccactcttctccccgtcaccatcgttcttcatgtcatctgaccgcccttctgattttccatttgcatcatcaaacatatccttggtctcagctttctctgtcggcacttccggctccttctcttcaggcttctcctctggcttctcagtgaacttctcttccatcgtggcatccttgttattcggctcctccggcatcgtggcatcattgttgtcggtgtcctcaaatttctcagaaccttcaccagcattgtcctgtgaggccccaaaattgacaggcgcaggctgctgcttcaccaccggcttcttattcgaggagatctccagcgggaagacagtggacgaggtcatcatccacgcgccgaccaggcagagcgccacaaagacgacgaccgtggtggtcgtgcagaacgacgacgacgtcgaggacggccggcggccgtccatcttcccacctcggccaaatgccattagtgcctggcgaacatgtaccagagcaccgaccttcacgcgatttatctccaccaactactgctggaccaagaacccccaaaaaaatcgcacctttgtctgctttgtgctgctacagccgcgcggcacctgaagcaaaccacaaaaaaaacttaaatcgccgcggacataaatcaaggtgctggatctaaagaacaaacgctggatctactcaagcaacaacggaaggaagatccgctattggtgctagtattagcttcttgtttcctagtactacagcggctctttcccagtataagaacacgggaaaacgcggagaaatcccccttcgtggccaaacatggaaagaaaattagtaaagcgtgtgctttaaaaccccctcgttctgttccttccgcggagagctaccgcatcttccaattgagctggttctcagctgggcgcaaaacgcgcactaatcaatgtccgattccatccacaaagaaaaaaaagacgggaacagctaatccagcagctcgctcgctagctagctagctcatcggcggaaggacggaaccagctttgctggatccaggacagcaagagtgtgcaaggagaaagaacggagcagcaatgcggattgcggaggcggtggattggtacctcgccggaaccgaccggagtggtcgcggtggccctccgcgcggatctcgaagaggagcgaggaaggggaaggcggatgcgcgtccttgggttctctgccaccgcactgggcctcgccgcgttataaaggcgggcgggcgggcgggcagcgcagtgtgagtggagtgcaatctgttgtgtagtgtgtgaagaggcggaagcggaagcggaggagatgggttcgcattagacgaccgtacgtaattatacgctatactagtacttgggttagattactcgggagatcttggccaaaatgtccggtctgagtgtttggtagttttatggatttgcccttttaagatgttggtatttctccgggagcttagaaagaagaaatggcgatgctttaggccttgtttagatgcgaaaaaaatttggatttcgctactgtggcatttttatttgtttgtagcaaatattgtccaaacacggactaactaagattcatctcgcgatttacagttaaactgtacaattagtttttattttcatttatatttaatgtttcatggatgtgtcgaaagatacgatatgatagaaaattttgaaaactttttagttattgaggttaactaaacaatgccttaattgagaatttactcgagcaaaaagagttaggtcagtctcagtggagagtttcatggtgttgtttccaagactgccatatcatgtgaaatgaaatgaaacttggttgaaacactcactctcaatggagagtttcattttatagtttcatgggcatttaatttcaatactcatagagagttgatatcgtgccaactcatttcttctctctcttcttaaatacacagtcatatcatcaaaaaaaatcctatgtagcaacatatttaatgcaaataaaactcatatggtggactgtaggagtagcattaggccaagggcacacacacggtcacggtgtgagtgcgacggtgcgagtgggcccgcggcggtagtaagtgcgtgcgcgcccggcgcccccctccgcggcgacgacgcagcggcagcgcgtcgtccagtgcaccgtctgctgttcggcgctgcgggtcctccgcgccacggcgcagtgaaccgggcgcgtgcatcccgggagcggcggcttggcactcccctgcttgtcggtggcggccgtcggcatcgctcggccccggagcgtcacgaggctgctgattgggagcgagagcgagtagtggggctggttggggacaatcccattcccacccggcccaccaggctgggactggcccactagtcactagtgggtggctcatgggtgtgggtgggctggctaatgccgcctgcccaacaaccaacccaacccctgtggacgctggtaccggtagttgccgcgccatggtggactgctgccgcctgatgcctttgcctgccacgctccacgagttgaggcgcaccaaactgtgctgtgctcctgatttgtgctaatcggccgacgcgtaccattctttctttctttcgtctacgcgcagagaggccggttgactgtttcttcgttggagggccatgttgactcgtactaataataaaaataataatactaggttgactttttcaattccaacgcagcagtgcaaagctgcccacctatgagcacaggtccttttttaactccgtttttgtacgtacacacgtactgtccagcctgtgtctaataatcttaccaaaaacctgtcatctcactatcaaccaatcaggctctccgcctgttcgtcgaggaacagcagttgttttccctactccaacatagagtacactatggacgcacattaccatgccagcttgagcttagcattgcccaccgttggataactgccatgccattctcaggccctgtttagttcccatctaaaaatttttcatccattccatcgaatctttggacacatgcatggaacattaaatgtagataaaaaaataaactaattacacagtttagttgagaatcgcgagacgaatcttttaagtctagttactccataattagccttaagtgctacagtaatccacatatactaatgacagattaattatgcttaataaatttgtcttacagtttcctgacgagctatgtaatttgtttttttattagtttctaaaaacccctcccgacatccttccgacatatccgatgtgacaaccaaaaaattttcatcttcaatctaaacaggccctcactctcatcatctcatgccggggcagcaggtccgtcgtcaggtctgtcgtcccgtcccgtgccgtctgaagcaacaggcgagagaaacgccgttccatcggtttgccgagcgtgcagaggatagagctatactcgatccggagaggattgtgaaacgaagcacggttaagcagtgccgcgcacgtgctgctctgctcctggatccgatccagatcgactcggggcgtctcggcctcagcggcgatggcaatcatcgcgcgcgctgctggagctggacgttttcgtcttgcattgcaggaggcggaacagaacggagaaagccacggcgcgctttgccgacgccacgcgctgacacgagggacccgttcagcggccagcacgcagcctaatcatgcctgtcggggggagctcatccgttcctgaatttgggtcatgctccagtatcaggtattcaggtactagtactcctgagccatgtgctgcgacaaaaaagcgaggctcctgtagtagagccttgtttacttacaaaattttttacattctcagttatattaaatcttgtgacacatgcataaagcattaaatatacataaaagaaataattatttacacagttacttataatttgcgaaacgaatcttttaagactggttagtttatgattagataatatttattaaatacaaatgaaagtaatattatttatattttgcaaaaagtaaataagacctaggtagctaggccaacgtgagcatgtcggacccggaccggttcgttctacggcgcgtcccgcaaacctgcagccaggtagtagtagtacaccgtgcacgggagaggtgcgccatgcatgctcgggcaaaagatcatagagaaaggtgcagcgtttcagttgcacacctgaccgagtgacgcctcgccttgtttggctttgttcccaaaattttttaaaattcctcatcacattaaatctttgaacgaatatatggagcattaaatataaataaaagaaataattaatcatacaatttgtctgtaatttgcgagacgaatcttttgagcctagttagtttataattaaataatatttgttaaatacaaacgaaaatgctacgttagccaaaactaaaatttttctccaaacgtgacccagcaccttccgatcaatcatcactcagcgggtcacgtcagaagatcagatggaccttgccgtccgggcctgtctctcggcctcctccccatctggaacgaacagaggtccagtcctgtttcgagtcgagctgagtcgatcagatgggcctaaataggccgaagacgtaggcaaagggcccgctgatttatctgattcttctaggaccgtgcatgcgcggatgggcctaggtggaaacccaacagatgtgaggcttcaaagaggaagaagtccgttacacatggagagttagtctataatgggataatatttaccacaaacaaataaaaatactacagtagcgaaatccaaaatttttcacatctaaacaaggccctagatgttttgtcagtgccagaccagagaaaatctcgtcttctgctgtcaatagctttgatgattcctggcggcagaggtaaagcttgcctgggccttgtttagttccgaaaagtgaaaagttttcggtactgtagcacttttgtttgttcgtgacaaatatcatccaattatggactaactagaattaaaagattcgtctcgtgatctacagctaaactgtgtaattagtttttgttttcgtctatatttaatgtttcatgcatgtgccacaagattcgatgtgacggagaattttgaaaattttttggttttcagagtgaactaaacaaggcccagatgtaattgaccatgccatcgagcgcgagttgactagagtgagtcggccctgatggttaagtagtgcagactgccaagtggacaaccgtctatcaactttgcagagtggggcgaatgcactgaggatgttggagaggggcaagccaaggtaaacttgaggaaagatgcttgttgacactgtagtatgtgaacaatcctgtttaattttgtgtcctcgacg

SEQ ID NO: 88 - DNA, 1790 bp, Setaria italica
tctcatggtgtcccaagcacagcaagagccagctctgcctcacagcagcagcaccgccaagcgcgcagccgcgtcactcatggacgcccgcccggcccagcctctcctcctccgcgccccgactcccagcattgacctccccgcgtccaagccggacagggccgccgcggcggccggcaaggccgccgccgcctccgtgttcgacctgcggcgggagcccaagatcccggcgccattcgtgtggccgcacgacgacgcgcggccggcgtcggcggcggagctggacgtgccgttggtggacgtgggcgtgctgcgcaatggcgaccgcgcggggctgcggcgcgctgcggcgcaggtggccgcggcgtgcgcgacgcacgggttcttccaggtgtgcgggcacggcgtgggcgcggacctggcgcgcgcggcgctggacggcgccagtgacttcttccggctgccgctggcggagaagcagcgcgcccggcgcgtcccggggaccgtgtccgggtacacgagcgcgcacgccgaccggttcgcgtccaagctcccctggaaggagaccctctccttcgggttccacgacggcgccgcgtcgcccgtcgtcgtcgactacttcgccggcaccctcgggcaggacttcgaggcagtggggcgggtgtaccagaggtactgcgaggagatgaaggctctgtcgctgacgatcatggagctcctggagctgagcctgggcgtggagcgcggctactaccgcgacttcttcgaggacagccgctccatcatgcggtgcaactactacccgccgtgcccggagccggagcgcacgctgggcacgggcccgcactgcgaccccaccgcgctgaccatcctcctccaggacgacgtcggcgggctcgaggtcctcgtcgacggcgactggcgccccgtccgccccgtccccggcgccatggtcatcaacatcggcgacaccttcatggctctgtccaacgggcggtacaagagctgcctgcaccgggcggtggtgaaccagcggcaggagcggcggtcgctggccttcttcctgtgcccgcgcgaggaccgggtggtgcgcccgccggccagcggcgccgtcggcgaggcgccccgccgctacccggacttcacctgggccgacctcatgcgcttcacgcagcgccactaccgcgccgacacccgcacgctggacgccttcacacgctggctctcccacggcccggcccaggacgcgccagtggcggcggcggcttccacctagctagcggcgcggatccgaccgagcccattgacgacgccgtccctttccgccgccgccggggcccgcgcgggggttcaccccacgtgcgcgcccaggtgggcgaggtggcggcctcgtggcccgcgggccccgcgccgccttcccatttttgggcgctgccgccccgcgcgcatgccggatgcgtgcgtccacggcctactgctgctactagtgtacatatacaaacatacatatatacgtagtataaatatataagcaagcggcccggtgccccttttcgttttcttgttttgtcgatcacaatctctggattcgatggatggataaatgtttgtacgcatgcatgtagatgggctcatgaaatttcagaatctggaacggacgaggagctcacgtgcctcttccgtgtctggtagcggtagctgcgtgccaaatgtctggtgggcccaaagaaattctagtgccacccgtccggatccggcatccgaaagttcccgacggttcgacacccgaa

SEQ ID NO: 89 - DNA, 1272 bp, Setaria italica
atggtgtcccaagcacagcaagagccagctctgcctcacagcagcagcaccgccaagcgcgcagccgcgtcactcatggacgcccgcccggcccagcctctcctcctccgcgccccgactcccagcattgacctccccgcgtccaagccggacagggccgccgcggcggccggcaaggccgccgccgcctccgtgttcgacctgcggcgggagcccaagatcccggcgccattcgtgtggccgcacgacgacgcgcggccggcgtcggcggcggagctggacgtgccgttggtggacgtgggcgtgctgcgcaatggcgaccgcgcggggctgcggcgcgctgcggcgcaggtggccgcggcgtgcgcgacgcacgggttcttccaggtgtgcgggcacggcgtgggcgcggacctggcgcgcgcggcgctggacggcgccagtgacttcttccggctgccgctggcggagaagcagcgcgcccggcgcgtcccggggaccgtgtccgggtacacgagcgcgcacgccgaccggttcgcgtccaagctcccctggaaggagaccctctccttcgggttccacgacggcgccgcgtcgcccgtcgtcgtcgactacttcgccggcaccctcgggcaggacttcgaggcagtggggcgggtgtaccagaggtactgcgaggagatgaaggctctgtcgctgacgatcatggagctcctggagctgagcctgggcgtggagcgcggctactaccgcgacttcttcgaggacagccgctccatcatgcggtgcaactactacccgccgtgcccggagccggagcgcacgctgggcacgggcccgcactgcgaccccaccgcgctgaccatcctcctccaggacgacgtcggcgggctcgaggtcctcgtcgacggcgactggcgccccgtccgccccgtccccggcgccatggtcatcaacatcggcgacaccttcatggctctgtccaacgggcggtacaagagctgcctgcaccgggcggtggtgaaccagcggcaggagcggcggtcgctggccttcttcctgtgcccgcgcgaggaccgggtggtgcgcccgccggccagcggcgccgtcggcgaggcgccccgccgctacccggacttcacctgggccgacctcatgcgcttcacgcagcgccactaccgcgccgacacccgcacgctggacgccttcacacgctggctctcccacggcccggcccaggacgcgccagtggcggcggcggcttccacctag

SEQ ID NO: 90 - protein, 423 aa, Setaria italica
MVSQAQQEPALPHSSSTAKRAAASLMDARPAQPLLLRAPTPSIDLPASKPDRAAAAAGKAAAASVFDLRREPKIPAPFVWPHDDARPASAAELDVPLVDVGVLRNGDRAGLRRAAAQVAAACATHGFFQVCGHGVGADLARAALDGASDFFRLPLAEKQRARRVPGTVSGYTSAHADRFASKLPWKETLSFGFHDGAASPVVVDYFAGTLGQDFEAVGRVYQRYCEEMKALSLTIMELLELSLGVERGYYRDFFEDSRSIMRCNYYPPCPEPERTLGTGPHCDPTALTILLQDDVGGLEVLVDGDWRPVRPVPGAMVINIGDTFMALSNGRYKSCLHRAVVNQRQERRSLAFFLCPREDRVVRPPASGAVGEAPRRYPDFTWADLMRFTQRHYRADTRTLDAFTRWLSHGPAQDAPVAAAAST

SEQ ID NO: 91 - DNA, 2888 bp, Setaria italica
tctcatggtgtcccaagcacagcaagagccagctctgcctcacagcagcagcaccgccaagcgcgcagccgcgtcactcatggacgcccgcccggcccagcctctcctcctccgcgccccgactcccagcattgacctccccgcgtccaagccggacagggccgccgcggcggccggcaaggccgccgccgcctccgtgttcgacctgcggcgggagcccaagatcccggcgccattcgtgtggccgcacgacgacgcgcggccggcgtcggcggcggagctggacgtgccgttggtggacgtgggcgtgctgcgcaatggcgaccgcgcggggctgcggcgcgctgcggcgcaggtggccgcggcgtgcgcgacgcacgggttcttccaggtgtgcgggcacggcgtgggcgcggacctggcgcgcgcggcgctggacggcgccagtgacttcttccggctgccgctggcggagaagcagcgcgcccggcgcgtcccggggaccgtgtccgggtacacgagcgcgcacgccgaccggttcgcgtccaagctcccctggaaggagaccctctccttcgggttccacgacggcgccgcgtcgcccgtcgtcgtcgactacttcgccggcaccctcgggcaggacttcgaggcagtggggtaagtatgtaggaatgaacttggcacgcattgcatccacatggcgtgctgatcgaacgagctgagccaaccggcatgcacacatggcgtggcaggcgggtgtaccagaggtactgcgaggagatgaaggctctgtcgctgacgatcatggagctcctggagctgagcctgggcgtggagcgcggctactaccgcgacttcttcgaggacagccgctccatcatgcggtgcaactactacccgccgtgcccggagccggagcgcacgctgggcacgggcccgcactgcgaccccaccgcgctgaccatcctcctccaggacgacgtcggcgggctcgaggtcctcgtcgacggcgactggcgccccgtccgccccgtccccggcgccatggtcatcaacatcggcgacaccttcatggtacggccgccgctaatccatccttttgttgctcttatctcctctggcgagtgcgagtaacgaaagcgctagctcccctgctccttgtcctgctctgtttcccaagtcctaatggagctaaccgggcagactgcaacacgcacgcgtaggcatgtcacgtagccaccacttgcactgtgctgcgcagcgacgacgcaacgcggacgtgcgttcgagtcggttccatctcggcgccgctacacgcggccgcggctcctagcctcctagggctccctgatccctatccccgagcccttccgcgggaaaagttcgttggcgacggcagaggagagccgacgggtccgtgccgttggagcgtggcggcaggagaggccgggagggtgttttgttgcgttgcgcggcggcgcggaggatgcgatggcgcgggcgggcggcgctttcggcggtggcccccgcgacccacgtgcgcgcgcggtctcgtcgccttccctgttttggtgccacctctctgtgtccgggaatgggttggcttagcggcgaccgagaccgggcggtggtctggcctgctcccggcgcccatcccgcctggtctctcatcctgctcctcctatgcgcgagggggcctgtagcggctggagtacaagcagattggttgggttgggttgctgctgcttggctgttgcccgcccgctttctagccgtttccgctcgccatccggcacgcggcgcccacgccggggctccagctcggcccctttggccgtgtgggtggcaggcacccctgcatcgtctcgtgcgtccggtttccgcgcctggccccccgccttgaggtttccctgtgcttttgacaagactttcgtagatatatgtgtgtgtatgtgtgtgtgtgcgtgcgcgcgtgtgtgtatatatatatataaataaataacatctgtgaatgatggattacacgtgtagctgaccggctgattgtgttcgcgtgtgtgtcttcgatgcattgcaggctctgtccaacgggcggtacaagagctgcctgcaccgggcggtggtgaaccagcggcaggagcggcggtcgctggccttcttcctgtgcccgcgcgaggaccgggtggtgcgcccgccggccagcggcgccgtcggcgaggcgccccgccgctacccggacttcacctgggccgacctcatgcgcttcacgcagcgccactaccgcgccgacacccgcacgctggacgccttcacacgctggctctcccacggcccggcccaggacgcgccagtggcggcggcggcttccacctagctagcggcgcggatccgaccgagcccattgacgacgccgtccctttccgccgccgccggggcccgcgcgggggttcaccccacgtgcgcgcccaggtgggcgaggtggcggcctcgtggcccgcgggccccgcgccgccttcccatttttgggcgctgccgccccgcgcgcatgccggatgcgtgcgtccacggcctactgctgctactagtgtacatatacaaacatacatatatacgtagtataaatatataagcaagcggcccggtgccccttttcgttttcttgttttgtcgatcacaatctctggattcgatggatggataaatgtttgtacgcatgcatgtagatgggctcatgaaatttcagaatctggaacggacgaggagctcacgtgcctcttccgtgtctggtagcggtagctgcgtgccaaatgtctggtgggcccaaagaaattctagtgccacccgtccggatccggcatccgaaagttcccgacggttcgacacccgaa

SEQ ID NO: 92 - DNA, 1567 bp, Oryza sativa
tgcccagacagctcgccctgcacacacacacacactcacactcacacacgctctcaactcactcccgctcaacacagcgctcacttctcatctccaatctcatggtggccgagcaccccacgccaccacagccgcaccaaccaccgcccatggactccaccgccggctctggcattgccgccccggcggcggcggcggtgtgcgacctgaggatggagcccaagatcccggagccattcgtgtggccgaacggcgacgcgaggccggcgtcggcggcggagctggacatgcccgtggtcgacgtgggcgtgctccgcgacggcgacgccgaggggctgcgccgcgccgcggcgcaggtggccgccgcgtgcgccacgcacgggttcttccaggtgtccgagcacggcgtcgacgccgctctggcgcgcgccgcgctcgacggcgccagcgacttcttccgcctcccgctcgccgagaagcgccgcgcgcgccgcgtcccgggcaccgtgtccggctacaccagcgcccacgccgaccgcttcgcctccaagctcccatggaaggagaccctctccttcggcttccacgaccgcgccgccgcccccgtcgtcgccgactacttctccagcaccctcggccccgacttcgcgccaatggggagggtgtaccagaagtactgcgaggagatgaaggagctgtcgctgacgatcatggaactcctggagctgagcctgggcgtggagcgaggctactacagggagttcttcgcggacagcagctcaatcatgcggtgcaactactacccgccatgcccggagccggagcggacgctcggcacgggcccgcactgcgaccccaccgccctcaccatcctcctccaggacgacgtcggcggcctcgaggtcctcgtcgacggcgaatggcgccccgtcagccccgtccccggcgccatggtcatcaacatcggcgacaccttcatggcgctgtcgaacgggaggtataagagctgcctgcacagggcggtggtgaaccagcggcgggagcggcggtcgctggcgttcttcctgtgcccgcgggaggacagggtggtgcggccgccgccgagcgccgccacgccgcagcactacccggacttcacctgggccgacctcatgcgcttcacgcagcgccactaccgcgccgacacccgcacgctcgacgccttcacgcgctggctcgcgccgccggccgccgacgccgccgcgacggcgcaggtcgaggcggccagctgatcgccgaacggaacgaaacggaacgaacagaagccgatttttggcggggcccacgcccacgtgaggccccacgtggacagtgggcccgggcggaggtggcacccacgtggaccgcgggccccgcgccgccttccaattttggaccctaccgctgtacatattcatatattgcaagaagaagcaaaacgtacgtgtgggttgggttgggcttctctctattactaaaaaaaatataatggaacgacggatgaatggatgcttatttatttatctaaattgaattcgaattcggctca

SEQ ID NO: 93 - DNA, 1170 bp, Oryza sativa
atggtggccgagcaccccacgccaccacagccgcaccaaccaccgcccatggactccaccgccggctctggcattgccgccccggcggcggcggcggtgtgcgacctgaggatggagcccaagatcccggagccattcgtgtggccgaacggcgacgcgaggccggcgtcggcggcggagctggacatgcccgtggtcgacgtgggcgtgctccgcgacggcgacgccgaggggctgcgccgcgccgcggcgcaggtggccgccgcgtgcgccacgcacgggttcttccaggtgtccgagcacggcgtcgacgccgctctggcgcgcgccgcgctcgacggcgccagcgacttcttccgcctcccgctcgccgagaagcgccgcgcgcgccgcgtcccgggcaccgtgtccggctacaccagcgcccacgccgaccgcttcgcctccaagctcccatggaaggagaccctctccttcggcttccacgaccgcgccgccgcccccgtcgtcgccgactacttctccagcaccctcggccccgacttcgcgccaatggggagggtgtaccagaagtactgcgaggagatgaaggagctgtcgctgacgatcatggaactcctggagctgagcctgggcgtggagcgaggctactacagggagttcttcgcggacagcagctcaatcatgcggtgcaactactacccgccatgcccggagccggagcggacgctcggcacgggcccgcactgcgaccccaccgccctcaccatcctcctccaggacgacgtcggcggcctcgaggtcctcgtcgacggcgaatggcgccccgtcagccccgtccccggcgccatggtcatcaacatcggcgacaccttcatggcgctgtcgaacgggaggtataagagctgcctgcacagggcggtggtgaaccagcggcgggagcggcggtcgctggcgttcttcctgtgcccgcgggaggacagggtggtgcggccgccgccgagcgccgccacgccgcagcactacccggacttcacctgggccgacctcatgcgcttcacgcagcgccactaccgcgccgacacccgcacgctcgacgccttcacgcgctggctcgcgccgccggccgccgacgccgccgcgacggcgcaggtcgaggcggccagctga

SEQ ID NO: 94 - protein, 389 aa, Oryza sativa
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSEHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPQHYPDFTWADLMRFTQRHYRADTRTLDAFTRWLAPPAADAAATAQVEAAS

SEQ ID NO: 95 - DNA, 3140 bp, Oryza sativa
tgcccagacagctcgccctgcacacacacacacactcacactcacacacgctctcaactcactcccgctcaacacagcgctcacttctcatctccaatctcatggtggccgagcaccccacgccaccacagccgcaccaaccaccgcccatggactccaccgccggctctggcattgccgccccggcggcggcggcggtgtgcgacctgaggatggagcccaagatcccggagccattcgtgtggccgaacggcgacgcgaggccggcgtcggcggcggagctggacatgcccgtggtcgacgtgggcgtgctccgcgacggcgacgccgaggggctgcgccgcgccgcggcgcaggtggccgccgcgtgcgccacgcacgggttcttccaggtgtccgagcacggcgtcgacgccgctctggcgcgcgccgcgctcgacggcgccagcgacttcttccgcctcccgctcgccgagaagcgccgcgcgcgccgcgtcccgggcaccgtgtccggctacaccagcgcccacgccgaccgcttcgcctccaagctcccatggaaggagaccctctccttcggcttccacgaccgcgccgccgcccccgtcgtcgccgactacttctccagcaccctcggccccgacttcgcgccaatggggtaattaaaacgatggtggacgacattgcatttcaaattcaaaacaaattcaaaacacaccgaccgagattatgctgaattcaaacgcgtttgtgcgcgcaggagggtgtaccagaagtactgcgaggagatgaaggagctgtcgctgacgatcatggaactcctggagctgagcctgggcgtggagcgaggctactacagggagttcttcgcggacagcagctcaatcatgcggtgcaactactacccgccatgcccggagccggagcggacgctcggcacgggcccgcactgcgaccccaccgccctcaccatcctcctccaggacgacgtcggcggcctcgaggtcctcgtcgacggcgaatggcgccccgtcagccccgtccccggcgccatggtcatcaacatcggcgacaccttcatggtaaaccatctcctattctcctctcctctgttctcctctgcttcgaagcaacagaacaagtaattcaagcttttttttctctctcgcgcgaaattgacgagaaaaataagatcgtggtaggggcggggctttcagctgaaagcgggaagaaaccgacctgacgtgatttctctgttccaatcacaaacaatggaatgccccactcctccatgtgttatgatttatctcacatcttatagttaataggagtaagtaacaagctacttttttcatattatagttcgtttgattttttttttttaaagtttttttagttttatccaaatttattgaaaaacttagcaacgtttataataccaaattagtctcatttagtttaatattgtatatattttgataatatatttatgttatattaaaaatattactatatttttctataaacattattaaaagccatttataatataaaatggaaggagtaattaatatggatctcccccgacatgagaatattttccgatggtgtgacgacgccatgtaagcttcggtgggcctggacggccagaggtgccaacagccacgtccaacaacccctgggtccccccctaacactccaaacagtagtgagtagtgtctcgtcgcgttttagtatttgatgacaaacaaagtgtgagttgagttagccaccaccaacttgcacacgagcacatacatttgtgtccattctcgccagtcacttccatctctagtcctaactcctatctagcgatgtaagcggataatttcatcatccgtatataaacctgtttgttatagttaatttcctatataatactataacagtatacattttaaaagaaaacaaaattaggataaacaggccctgctcctatccatccatggcacttggaaggaccagactcggtcatgccatgccaagccaagatatgggttatggaagagtagagaagaggagagatgagagataagcatgcgttctcctcctcgttggatgtgtattttggagggatttgtgtagtagtagcagcggcgccgcggggacggatgcggatggtggcgctttcggtggcgttttcccgggggggttttggtttggcgcttgggggggatggcatggcgcggcgtgcggctgcacgccacacacacgcgcgcgcacgcacgtacgtcgtcgtcgccgcgggcggacggtagcttagggtggtgtgttccgcgcgcgggcgcggattgttccatgccgatcgatttggcgccaccctcgccgcggctcttgtcgcgtcgtgcgcctctctcgcgcggtttgtccttgtcgcgttgctcagccggcgacgggggcacggacattggcgatgtagccctgcacgtgtcggcctctccgttgatgaatgatgatgtatgtatgtatttttttttgtctgaaggaatttgtggggaattgttgtgtgtgcaggcgctgtcgaacgggaggtataagagctgcctgcacagggcggtggtgaaccagcggcgggagcggcggtcgctggcgttcttcctgtgcccgcgggaggacagggtggtgcggccgccgccgagcgccgccacgccgcagcactacccggacttcacctgggccgacctcatgcgcttcacgcagcgccactaccgcgccgacacccgcacgctcgacgccttcacgcgctggctcgcgccgccggccgccgacgccgccgcgacggcgcaggtcgaggcggccagctgatcgccgaacggaacgaaacggaacgaacagaagccgatttttggcggggcccacgcccacgtgaggccccacgtggacagtgggcccgggcggaggtggcacccacgtggaccgcgggccccgcgccgccttccaattttggaccctaccgctgtacatattcatatattgcaagaagaagcaaaacgtacgtgtgggttgggttgggcttctctctattactaaaaaaaatataatggaacgacggatgaatggatgcttatttatttatctaaattgaattcgaattcggctca

SEQ ID NO: 96 - DNA, 1170 bp, Triticum aestivum
atggacaccagccctgcaactcccctgctcctccagcctcctgctcccagcattgacccgttcgccgccaaggcggccgtcaacaagggcggcggcgcggcaaccgcggtgtacgacctccggagggagccgaagatccccgccccgttcgtgtggccgcacgccgaggtgcgccccaccacggcccaggagctggccgtgccggtggtggacgtgggcgtgctgcgcaatggcgacgccgcggggctccgccgcgccgtggcgcaggtggccgcggcgtgcgccacgcacgggttcttccaggtgtccgggcacggcgtggacgaggccctggcgcgcgcggcgctggacggcgcgagcggcttcttccggctgccgctggccgagaagcagcgcgcgcggcgcgtcccggggaccgtgtccgggtacacgagcgcgcacgccgaccggttcgcctccaagctcccctggaaggagaccctctccttcggcttccacgaccgcgccggcgccgcgcccgtcgtggtggactacttcaccagcaccctcgggccggactacgagccaatggggagggtgtaccaggagtactgcgggaagatgaaggagctgtcgctgaggatcatggagctgctggagctgagccagggcgtggagaagcgcgggtactaccgggagttcttcgcggacagcagctccatcatgcggtgcaactactacccgccgtgcccggagccggagcgcacgctgggcacgggcccgcactgcgaccccacggcgctcaccatcctactgcaggacgacgtgggcgggctggaggtcctcgtcgacggcgactggcgccccgtccgccccgtccccggcgccatggtcatcaacatcggcgacaccttcatggcgctgtcgaacgggcggtacaagagctgcctgcaccgcgcggtggtgaaccggcggcaggagcggcggtcgctggccttcttcctgtgcccgcgcgaggaccgcgtggtgcggccgccgccgggcctgaggagcccgcggcggtacccggacttcacctgggctgacctcatgcgcttcacgcagcgccactaccgcgccgacacgcgcaccctcgacgccttcacccagtggttctcctcctcctcctcctcggcccaggaggcggcctga

SEQ ID NO: 97 - protein, 389 aa, Triticum aestivum
MDTSPATPLLLQPPAPSIDPFAAKAAVNKGGGAATAVYDLRREPKIPAPFVWPHAEVRPTTAQELAVPVVDVGVLRNGDAAGLRRAVAQVAAACATHGFFQVSGHGVDEALARAALDGASGFFRLPLAEKQRARRVPGTVSGYTSAHADRFASKLPWKETLSFGFHDRAGAAPVVVDYFTSTLGPDYEPMGRVYQEYCGKMKELSLRIMELLELSQGVEKRGYYREFFADSSSIMRCNYYPPCPEPERTLGTGPHCDPTALTILLQDDVGGLEVLVDGDWRPVRPVPGAMVINIGDTFMALSNGRYKSCLHRAVVNRRQERRSLAFFLCPREDRVVRPPPGLRSPRRYPDFTWADLMRFTQRHYRADTRTLDAFTQWFSSSSSSAQEAA

SEQ ID NO: 98 - DNA, 3050 bp, Triticum aestivum
ctcatggtgctccagaccgctcagcaagaaccatccctgacgcgtccgcctcactgcagcgtcgccagcgcgcgctcgccggcggccatggacaccagccctgcaactcccctgctcctccagcctcctgctcccagcattgacccgttcgccgccaaggcggccgtcaacaagggcggcggcgcggcaaccgcggtgtacgacctccggagggagccgaagatccccgccccgttcgtgtggccgcacgccgaggtgcgccccaccacggcccaggagctggccgtgccggtggtggacgtgggcgtgctgcgcaatggcgacgccgcggggctccgccgcgccgtggcgcaggtggccgcggcgtgcgccacgcacgggttcttccaggtgtccgggcacggcgtggacgaggccctggcgcgcgcggcgctggacggcgcgagcggcttcttccggctgccgctggccgagaagcagcgcgcgcggcgcgtcccggggaccgtgtccgggtacacgagcgcgcacgccgaccggttcgcctccaagctcccctggaaggagaccctctccttcggcttccacgaccgcgccggcgccgcgcccgtcgtggtggactacttcaccagcaccctcgggccggactacgagccaatggggtaatatatccacccgcccacacccctatccggccagcacgaatccatccccgccactgcatttttttccttttgtttccgcgcgaccgtacgttcgatcggcgcccacgtacgtacgtgcgtacgcagtagcagtacttgaagccgccgtactacgtgctgagtagtgacaactgaacacgtgcaggagggtgtaccaggagtactgcgggaagatgaaggagctgtcgctgaggatcatggagctgctggagctgagccagggcgtggagaagcgcgggtactaccgggagttcttcgcggacagcagctccatcatgcggtgcaactactacccgccgtgcccggagccggagcgcacgctgggcacgggcccgcactgcgaccccacggcgctcaccatcctactgcaggacgacgtgggcgggctggaggtcctcgtcgacggcgactggcgccccgtccgccccgtccccggcgccatggtcatcaacatcggcgacaccttcatggtaattactcctctctcagcgttgctttcgctgattaattgcagaaacagtagtcaactacccatgctctgttccgctgtgctctgcttcccaacgagcgaaccggcccataaaaactgccttgctgtcttggaaccaagaggaaagggaccgtgggagcctaccgacacgacgtgattgcactctgcttcctaacaagcgagccgccggtagggctatcaccgtaagggctcctttgattcaaaggaatttcttaggatttctgaaggattgaaatccttaggattttttcctatgttggtacttcgattcataggattgaatcccataggatttttttcctatgaaatcttctgtactacatttcataggaaatctaacatccactccaacctttttttatatttcctttgtttttcatgtgccatcaaacactccttgttaatcctataggattcaagtgggcatgccactccaatcctatacttttcccattcctacgttttcaaaatcctacgaatcaaagaggccctaaagctgctgacatgacgtgattttttttttcttttctttctttctttctcagctccaatcaacgctggttattagatcattagagtggacaggttgaattaacatgcagtagttagtagttagcagccacaaacgggtcccgttctctgaagtctgaactgacataagtcctgatcatcgaccattctttgcttcctaggacgatgcctgttggaacttgcgtccaatgcccgttagggagtggtaattgtcatcacttttagactcgtcgattccactgatgaagacgtagcacatggatgagccaacgtatccgtttctagtggtctcgaaaagtagggtttcattcattctatctatctatccgtccgtccaaaagggctgcgatgcgagcacttgagtcggagccaatcagagcgcgagaaaagatagggggggtagcaagccatgtcggaggggcgtttgcttccggcaggtttggattcttgtggtaggcgggcggctctgtacagtagcggcggtgacggtgaggtggcggcgctttcggtggcgggccaacccaggtgcatgcacgcgcgctcgtcgttttcccgcctgaatctgccgctgcgcccatggcaagggggtgggtgctgccgccgggcgatggagtagatcacggtcgccgtcgggctcggccagttgatcacggttcgttcgtgcggtactaggttcccccacggcactgtgactgcatcgttccggccctcgccattggcgatcgggcaatctcctgttcatccgtcgctgttgattcctcggccacgatagaccatgcgcgtgccggtcgtcgccccgtcgcgctcgcttcacgtgctcgtcgcgtggctcccgtcccacacgaggccgccgctttctgacccagtggagcgcgtgatttacagtttatatatgtcgctgcatttttctttttgtgtgctgctcattttgcttggacggagaccgggaacgattagccacggatctaacgcgttgttgcttgttttcaatgcatgcatgcaggcgctgtcgaacgggcggtacaagagctgcctgcaccgcgcggtggtgaaccggcggcaggagcggcggtcgctggccttcttcctgtgcccgcgcgaggaccgcgtggtgcggccgccgccgggcctgaggagcccgcggcggtacccggacttcacctgggctgacctcatgcgcttcacgcagcgccactaccgcgccgacacgcgcaccctcgacgccttcacccagtggttctcctcctcctcctcctcggcccaggaggcggcctgattctgctctgccacgaaacgatcggtccaca

SEQ ID NO: 99 - DNA, 1486 bp, Hordeum vulgare
gaccagtagcatatagtttttcttgtgtttgccatggtggacgtgtcgaactttgtagaagccaatggcaatgcagcagtatcgattcctgccatggaagttgctgggagtcctcacgtcccgttcgttcctcgggacgcgaacgcgacagacagcaagaatgccaaggacgtcctcgacctctggcggcagcagaaacaaatcccggctcccttcatctggccccacgccgacgcgcggccgtcgtcgatcttggagctggacgtgcccgtggtcgacatcggcgcggccctgcacagcgccgccgggatggcccgcgccgcggcgcaggtggccgaggcatgcgcgagccacggcttcttccaggtgaccgggcacggcgtcgaccccgcgctggcccaagcagcgctcgacggcgcagcggacttcttccgcctgccgctcgccaccaagcagcgcgcccgccgatccccggggaccgtcaaagggtacgcctccgcccacgccgaccgcttcgccgccaagcttccctggaaggagactctctccttcatccacaaccacgtccacgaggacgtcggcgcccgcgcaagcagtcacgtcgtcgactacttcacctccgcccttggcgacgacttcatgcacctaggggaggtgtaccaggagtactgtgaggcgatggaggacgcgtcgctggcgataatggaggtgctgggggtgagcctggggctggggagagggtactacagggacttcttcgccgacggcagctccatcatgaggtgcaactactacccgcggtgcccggagccggaccggacgctggggacggggccgcactgcgacccgtcggcgctgaccatcctgctgcaggacggcgaggtggacgggctccaggtgctcgtcgacggcgcatggcgctccgtgcggcccaagcccggcgagctcgtcgtaaacatcggcgacaccttcatggcgctgtcgaacggccggtacaagagctgcctccaccgcgcggtggtgcaccgggagaaggagcgccggtcgctggcctacttcctcgccccgcgggaggaccgggtggttcgcccgccgccttcgccggcgccggcgccgcggctctacccggacttcacctgggcggagctcatgcgattcacgcagcgccactaccgcgccgacgcccgcacgctcgacgccttcgcgtgctggctcgacctgcccagctgccccaccacgccccaggcccaagggactgtctagtgtctgtgatgtatcatctgtctcagctgttgtatacgaccacttgtgtctgctagctctgcgcttgtgtttcttatgtgagctaactaactaaatagtgtgtatatttcttgccgcgccttatgcaagccctagtctagaacatgtaataattaacttaagcatatacgttgatctttggtgtatttttcatatttccttcataatgaataatctattatgc

SEQ ID NO: 100 - DNA, 1230 bp, Hordeum vulgare
atggtggacgtgtcgaactttgtagaagccaatggcaatgcagcagtatcgattcctgccatggaagttgctgggagtcctcacgtcccgttcgttcctcgggacgcgaacgcgacagacagcaagaatgccaaggacgtcctcgacctctggcggcagcagaaacaaatcccggctcccttcatctggccccacgccgacgcgcggccgtcgtcgatcttggagctggacgtgcccgtggtcgacatcggcgcggccctgcacagcgccgccgggatggcccgcgccgcggcgcaggtggccgaggcatgcgcgagccacggcttcttccaggtgaccgggcacggcgtcgaccccgcgctggcccaagcagcgctcgacggcgcagcggacttcttccgcctgccgctcgccaccaagcagcgcgcccgccgatccccggggaccgtcaaagggtacgcctccgcccacgccgaccgcttcgccgccaagcttccctggaaggagactctctccttcatccacaaccacgtccacgaggacgtcggcgcccgcgcaagcagtcacgtcgtcgactacttcacctccgcccttggcgacgacttcatgcacctaggggaggtgtaccaggagtactgtgaggcgatggaggacgcgtcgctggcgataatggaggtgctgggggtgagcctggggctggggagagggtactacagggacttcttcgccgacggcagctccatcatgaggtgcaactactacccgcggtgcccggagccggaccggacgctggggacggggccgcactgcgacccgtcggcgctgaccatcctgctgcaggacggcgaggtggacgggctccaggtgctcgtcgacggcgcatggcgctccgtgcggcccaagcccggcgagctcgtcgtaaacatcggcgacaccttcatggcgctgtcgaacggccggtacaagagctgcctccaccgcgcggtggtgcaccgggagaaggagcgccggtcgctggcctacttcctcgccccgcgggaggaccgggtggttcgcccgccgccttcgccggcgccggcgccgcggctctacccggacttcacctgggcggagctcatgcgattcacgcagcgccactaccgcgccgacgcccgcacgctcgacgccttcgcgtgctggctcgacctgcccagctgccccaccacgccccaggcccaagggactgtctag

SEQ ID NO: 101 - protein, 409 aa, Hordeum vulgare
MVDVSNFVEANGNAAVSIPAMEVAGSPHVPFVPRDANATDSKNAKDVLDLWRQQKQIPAPFIWPHADARPSSILELDVPVVDIGAALHSAAGMARAAAQVAEACASHGFFQVTGHGVDPALAQAALDGAADFFRLPLATKQRARRSPGTVKGYASAHADRFAAKLPWKETLSFIHNHVHEDVGARASSHVVDYFTSALGDDFMHLGEVYQEYCEAMEDASLAIMEVLGVSLGLGRGYYRDFFADGSSIMRCNYYPRCPEPDRTLGTGPHCDPSALTILLQDGEVDGLQVLVDGAWRSVRPKPGELVVNIGDTFMALSNGRYKSCLHRAVVHREKERRSLAYFLAPREDRVVRPPPSPAPAPRLYPDFTWAELMRFTQRHYRADARTLDAFACWLDLPSCPTTPQAQGTV

SEQ ID NO: 102 - DNA, 1423 bp, Sorghum bicolor
cctctcatcacaggccccagcctcactcttctcacagcaagacatcgcagcctcacaaccacacagcaacgtgatcgccatgggcgggctcaccatggagcaggccttcgtgcaggcccccgagcaccgccccaagcccaccgtcaccgaggccaccggcatcctggtcatcgacctctcgcctctcaccgccagcgacaccgacgcggccgcggtggacgcgctggccgccgaggtgggcgcggcgagccgggactggggcttcttcgtggtggttggccacggcgtgcccgcggagaccgtggcgcgcgcgacggcggcgcagcgcgcgttcttcgcgctgccggcggagcggaaggccgccgtgcggaggagcgaggcggagccgctcgggtactacgagtcggagcacaccaagaacgtcagggactggaaggaggtgttcgacctcgtcccgcgcgatccgccgccgccagcagccgtggccgacggcgagctcgtcttcaagaacaagtggccccaggatctgccgggcttcagagaggcgctggaggagtacgcggcagcgatggaggagctgtcgttcaagctgctggagctgatcgcccggagcttgaagctgaggcccgaccggctgcacggcttcttcaaggaccagacgacgttcatccggctgaaccactaccctccatgcccgagcccggacctggcgctgggagtggggcggcacaaggacgcgggggcgctgaccatcctgtaccaggacgaagtgggcgggctggacgtccggcggcgctcctccgacggcggcggcggcgagtgggtgcgggtgaggcccgtgccggagtcgttcgtcatcaacgtcggcgacctcgtccaggtgtggagcaacgacaggtacgagagcgcggagcaccgggtgtcggtgaactcggcgagggagaggttctccatgccctacttcttcaacccggcgagctacaccatggtggagccggtggaggagctggtgagcgacgacgacccgcccaggtacgacgcctacagctggggcgagttcttcagcaccaggaagaacagcaacttcaagaagctcagcgtggagaacattcagatcgcgcatttcaagaagaccctcgtcctcgcctagataagcagcaggatactacaggtctacaggactaggacaagccgatcgaggtgaccggccgtcgtcttcagattcagtatatgcgtgtcgccgttcgtgttagaacaaattaataatgtgcgcgctgtgtgctgtgtgtgtggagtaaaaaaaaactaaacatggatgtgcatgttcaaaaaaaaaaacatggatgcgagtatgtttgggaataataacaggcttgtgacggtctggtttatttgcaaattcaaaccgaattggttgatcttc

SEQ ID NO: 103 - DNA, 1071 bp, Sorghum bicolor
atgggcgggctcaccatggagcaggccttcgtgcaggcccccgagcaccgccccaagcccaccgtcaccgaggccaccggcatcctggtcatcgacctctcgcctctcaccgccagcgacaccgacgcggccgcggtggacgcgctggccgccgaggtgggcgcggcgagccgggactggggcttcttcgtggtggttggccacggcgtgcccgcggagaccgtggcgcgcgcgacggcggcgcagcgcgcgttcttcgcgctgccggcggagcggaaggccgccgtgcggaggagcgaggcggagccgctcgggtactacgagtcggagcacaccaagaacgtcagggactggaaggaggtgttcgacctcgtcccgcgcgatccgccgccgccagcagccgtggccgacggcgagctcgtcttcaagaacaagtggccccaggatctgccgggcttcagagaggcgctggaggagtacgcggcagcgatggaggagctgtcgttcaagctgctggagctgatcgcccggagcttgaagctgaggcccgaccggctgcacggcttcttcaaggaccagacgacgttcatccggctgaaccactaccctccatgcccgagcccggacctggcgctgggagtggggcggcacaaggacgcgggggcgctgaccatcctgtaccaggacgaagtgggcgggctggacgtccggcggcgctcctccgacggcggcggcggcgagtgggtgcgggtgaggcccgtgccggagtcgttcgtcatcaacgtcggcgacctcgtccaggtgtggagcaacgacaggtacgagagcgcggagcaccgggtgtcggtgaactcggcgagggagaggttctccatgccctacttcttcaacccggcgagctacaccatggtggagccggtggaggagctggtgagcgacgacgacccgcccaggtacgacgcctacagctggggcgagttcttcagcaccaggaagaacagcaacttcaagaagctcagcgtggagaacattcagatcgcgcatttcaagaagaccctcgtcctcgcctag

SEQ ID NO: 104 - protein, 356 aa, Sorghum bicolor
MGGLTMEQAFVQAPEHRPKPTVTEATGILVIDLSPLTASDTDAAAVDALAAEVGAASRDWGFFVVVGHGVPAETVARATAAQRAFFALPAERKAAVRRSEAEPLGYYESEHTKNVRDWKEVFDLVPRDPPPPAAVADGELVFKNKWPQDLPGFREALEEYAAAMEELSFKLLELIARSLKLRPDRLHGFFKDQTTFIRLNHYPPCPSPDLALGVGRHKDAGALTILYQDEVGGLDVRRRSSDGGGGEWVRVRPVPESFVINVGDLVQVWSNDRYESAEHRVSVNSARERFSMPYFFNPASYTMVEPVEELVSDDDPPRYDAYSWGEFFSTRKNSNFKKLSVENIQIAHFKKTLVLA

SEQ ID NO: 105 - DNA, 1499 bp, Sorghum bicolor
cctctcatcacaggccccagcctcactcttctcacagcaagacatcgcagcctcacaaccacacagcaacgtgatcgccatgggcgggctcaccatggagcaggccttcgtgcaggcccccgagcaccgccccaagcccaccgtcaccgaggccaccggcatcctggtcatcgacctctcgcctctcaccgccagcgacaccgacgcggccgcggtggacgcgctggccgccgaggtgggcgcggcgagccgggactggggcttcttcgtggtggttggccacggcgtgcccgcggagaccgtggcgcgcgcgacggcggcgcagcgcgcgttcttcgcgctgccggcggagcggaaggccgccgtgcggaggagcgaggcggagccgctcgggtactacgagtcggagcacaccaagaacgtcagggactggaaggaggtgttcgacctcgtcccgcgcgatccgccgccgccagcagccgtggccgacggcgagctcgtcttcaagaacaagtggccccaggatctgccgggcttcaggtgacgaaatcaacttatcttttcgatcatattttaccatttaatagtttaacaataattgaacttttttttgcagagaggcgctggaggagtacgcggcagcgatggaggagctgtcgttcaagctgctggagctgatcgcccggagcttgaagctgaggcccgaccggctgcacggcttcttcaaggaccagacgacgttcatccggctgaaccactaccctccatgcccgagcccggacctggcgctgggagtggggcggcacaaggacgcgggggcgctgaccatcctgtaccaggacgaagtgggcgggctggacgtccggcggcgctcctccgacggcggcggcggcgagtgggtgcgggtgaggcccgtgccggagtcgttcgtcatcaacgtcggcgacctcgtccaggtgtggagcaacgacaggtacgagagcgcggagcaccgggtgtcggtgaactcggcgagggagaggttctccatgccctacttcttcaacccggcgagctacaccatggtggagccggtggaggagctggtgagcgacgacgacccgcccaggtacgacgcctacagctggggcgagttcttcagcaccaggaagaacagcaacttcaagaagctcagcgtggagaacattcagatcgcgcatttcaagaagaccctcgtcctcgcctagataagcagcaggatactacaggtctacaggactaggacaagccgatcgaggtgaccggccgtcgtcttcagattcagtatatgcgtgtcgccgttcgtgttagaacaaattaataatgtgcgcgctgtgtgctgtgtgtgtggagtaaaaaaaaactaaacatggatgtgcatgttcaaaaaaaaaaacatggatgcgagtatgtttgggaataataacaggcttgtgacggtctggtttatttgcaaattcaaaccgaattggttgatcttc

SEQ ID NO: 106 - DNA, 1490 bp, Setaria italica
accccacacacacacccgcactgcatgcggcgtcctagctaatcagtcgctgctggcagcctcacaagtcacacaactccgacgcaggaaagctcgatccatcgccatgggcggcttctccatggatcagtccttcgtgcaggcccccgagcaccgccccaagcccaccgtcaccgaggccacgggcatcccgctcatcgacctctcgccactcaccggcggtggcggcggcgacgcggccgccgtggacgcgctggccgccgaggtgggcgcggcgagccgggactggggcttcttcgtggtggtggggcacggtgtgccggcggagaccgtggcgcgcgccacggaggcgcagcgcgcgttcttcgccctgccggcggagcggaaagccgccgtgcggaggagcgaggcggagccgctcgggtactacgagtcggagcacaccaagaacgtcagggactggaaggaggtgtacgacctcgtcccgggcgggcttcagccgccgatagccgtggccgacggcgaggtcgtgttcgaaaacaagtggcccgaagacctgccgggattcagagaggcgttggaggagtacatgcaagcgatggaagagctggcattcaagatactggagctgatcgcccggagcctgaacctgaggcctgacagactgcacggcttcttcaaggaccagaccaccttcatccggctcaaccactaccctccctgcccgagccccgacctcgccctcggcgtcggccggcacaaggacgccggagcactgaccatcctctaccaggacgacgtcggcgggctcgacgtccggcgccgttccgacggcgattgggtccgcgtcaagcctgtccccgactccttcatcatcaacgtcggcgacctcatccaggtttggagcaacgacaggtacgagagcgcggagcaccgggttacggtgaactcggccaaggagaggttctccaggccctacttcttcaacccggcgggctacaccatggtggagccggtggaggagctggtgagcgaggaggacccgccccggtacgacgcctacaactggggcaacttcttcagcaccaggaagaacagcaacttcaagaagctgagcgtggagaacatccagatcgcgcatttcaagaggagcgtcgccgcctaggatacgcacagaaagatcccatatgctgacttgctgatgaggcgacaggcggccgtgtcgtcttcagattcagagactgggagtaaacatttgtgcggtgttctgtaatcgtgatgtgacgagaactttagatatatgtttggaaataacagccttgtgttggtctggcttatccgcaaagtcaagattttcttctacattttgggattattgttggtaagcattaagcaacgtccagttcttacttcttagctcgatcagtggacgtaggaccggcctctgatgacaagggtgatttatgagaaatgtcatgtatatatgttcc

SEQ ID NO: 107 - DNA, 1059 bp, Setaria italica
atgggcggcttctccatggatcagtccttcgtgcaggcccccgagcaccgccccaagcccaccgtcaccgaggccacgggcatcccgctcatcgacctctcgccactcaccggcggtggcggcggcgacgcggccgccgtggacgcgctggccgccgaggtgggcgcggcgagccgggactggggcttcttcgtggtggtggggcacggtgtgccggcggagaccgtggcgcgcgccacggaggcgcagcgcgcgttcttcgccctgccggcggagcggaaagccgccgtgcggaggagcgaggcggagccgctcgggtactacgagtcggagcacaccaagaacgtcagggactggaaggaggtgtacgacctcgtcccgggcgggcttcagccgccgatagccgtggccgacggcgaggtcgtgttcgaaaacaagtggcccgaagacctgccgggattcagagaggcgttggaggagtacatgcaagcgatggaagagctggcattcaagatactggagctgatcgcccggagcctgaacctgaggcctgacagactgcacggcttcttcaaggaccagaccaccttcatccggctcaaccactaccctccctgcccgagccccgacctcgccctcggcgtcggccggcacaaggacgccggagcactgaccatcctctaccaggacgacgtcggcgggctcgacgtccggcgccgttccgacggcgattgggtccgcgtcaagcctgtccccgactccttcatcatcaacgtcggcgacctcatccaggtttggagcaacgacaggtacgagagcgcggagcaccgggttacggtgaactcggccaaggagaggttctccaggccctacttcttcaacccggcgggctacaccatggtggagccggtggaggagctggtgagcgaggaggacccgccccggtacgacgcctacaactggggcaacttcttcagcaccaggaagaacagcaacttcaagaagctgagcgtggagaacatccagatcgcgcatttcaagaggagcgtcgccgcctag

SEQ ID NO: 108 - protein, 352 aa, Setaria italica
MGGFSMDQSFVQAPEHRPKPTVTEATGIPLIDLSPLTGGGGGDAAAVDALAAEVGAASRDWGFFVVVGHGVPAETVARATEAQRAFFALPAERKAAVRRSEAEPLGYYESEHTKNVRDWKEVYDLVPGGLQPPIAVADGEVVFENKWPEDLPGFREALEEYMQAMEELAFKILELIARSLNLRPDRLHGFFKDQTTFIRLNHYPPCPSPDLALGVGRHKDAGALTILYQDDVGGLDVRRRSDGDWVRVKPVPDSFIINVGDLIQVWSNDRYESAEHRVTVNSAKERFSRPYFFNPAGYTMVEPVEELVSEEDPPRYDAYNWGNFFSTRKNSNFKKLSVENIQIAHFKRSVAA

SEQ ID NO: 109 - DNA, 1886 bp, Setaria italica
accccacacacacacccgcactgcatgcggcgtcctagctaatcagtcgctgctggcagcctcacaagtcacacaactccgacgcaggaaagctcgatccatcgccatgggcggcttctccatggatcagtccttcgtgcaggcccccgagcaccgccccaagcccaccgtcaccgaggccacgggcatcccgctcatcgacctctcgccactcaccggcggtggcggcggcgacgcggccgccgtggacgcgctggccgccgaggtgggcgcggcgagccgggactggggcttcttcgtggtggtggggcacggtgtgccggcggagaccgtggcgcgcgccacggaggcgcagcgcgcgttcttcgccctgccggcggagcggaaagccgccgtgcggaggagcgaggcggagccgctcgggtactacgagtcggagcacaccaagaacgtcagggactggaaggaggtgtacgacctcgtcccgggcgggcttcagccgccgatagccgtggccgacggcgaggtcgtgttcgaaaacaagtggcccgaagacctgccgggattcaggtgaatcaacttgcgcatattgttgtttctggcattgcatatgatcgtcgtgccagtatgttttgacaatatttttgttttcatatttttggtgaagatgggaaaatctttgttgaaataatcagggaattttcacatctttttttaatcaaagatagaataggttcggttactgaattttgatgatggacagaaaaagctgtgttttcactttccatctcagcgatgtttttttgtggatgaattctcctaaatttttgtcttttcatgttaaaacttgaacgggaattctcgcagagaggcgttggaggagtacatgcaagcgatggaagagctggcattcaagatactggagctgatcgcccggagcctgaacctgaggcctgacagactgcacggcttcttcaaggaccagaccaccttcatccggctcaaccactaccctccctgcccgagccccgacctcgccctcggcgtcggccggcacaaggacgccggagcactgaccatcctctaccaggacgacgtcggcgggctcgacgtccggcgccgttccgacggcgattgggtccgcgtcaagcctgtccccgactccttcatcatcaacgtcggcgacctcatccaggtacaacaaacaaaaacacacgtcattctcaaatcttttcgtgctgttaatgctcattcacgaattgatatcttacatgaacgactgagactttttcaggtttggagcaacgacaggtacgagagcgcggagcaccgggttacggtgaactcggccaaggagaggttctccaggccctacttcttcaacccggcgggctacaccatggtggagccggtggaggagctggtgagcgaggaggacccgccccggtacgacgcctacaactggggcaacttcttcagcaccaggaagaacagcaacttcaagaagctgagcgtggagaacatccagatcgcgcatttcaagaggagcgtcgccgcctaggatacgcacagaaagatcccatatgctgacttgctgatgaggcgacaggcggccgtgtcgtcttcagattcagagactgggagtaaacatttgtgcggtgttctgtaatcgtgatgtgacgagaactttagatatatgtttggaaataacagccttgtgttggtctggcttatccgcaaagtcaagattttcttctacattttgggattattgttggtaagcattaagcaacgtccagttcttacttcttagctcgatcagtggacgtaggaccggcctctgatgacaagggtgatttatgagaaatgtcatgtatatatgttcc

SEQ ID NO: 110 - DNA, 1379 bp, Oryza sativa
aagccacacgcacacacacacacacgctgacacacgagacgaacacttgtgctacagcttctcgccaccagctactgatcgaccatgggcggcctctccatggaccaggcgttcgtgcaggcccccgagcaccgccccaaggcgtccgtcgccgaggccgacggcatcccggtcatcgacctctcccctctcctcgccgccggcgatggcgacgccgacggggtggacgcgctcgcggcggaggtcgggagggcgagccgggactggggcttcttcgtggtggtgcgccacggtgtgcccgcggaggcggtggcgcgcgcggcggaggcgcagaggacgttcttcgcgctgccgccggagcggagggcggccgtggcgcggagcgaggcggcgccgatggggtactacgcgtccgagcacaccaagaacgtcagggactggaaggaggtgttcgacctcgtcccgcgccagacgccgccgccgccgacgaccgccgtggccgacggcgacctggtgttcgacaacaagtggcccgacgacctgccgggattcagggaggcaatggaggagtacggcgaagcggtggaggagctggcgttcaagctgctggagctgatcgccaggagcctcggcctgagacccgaccgcctccatggcttcttcaaggacgaccagaccaccttcatccggctcaaccactaccctccctgcccgagccccgacctcgccctcggcgtcggccgccacaaggacgccggcgcgctcaccgtgctctaccaggacgatgtcggcggcctcgacgtccgccgccgatccgacggcgagtgggtgcgcgtcaggcccgtccctcactccttcatcatcaacgtcggcgacatcatccaggtgtggagcaatgacaggtacgagagcgcggagcaccgggtggcggtgaacgtggagaaggagaggttctccatccctttcttcttcaacccggcgggccacaccatggtggagccactggaggaggtcgtgagcgacgagagcccggccaggtacaacccctacaactggggcgaattcttcagcaccaggaagaacagcaacttcaagaagctggacgtggagaacgtccagatcacgcatttcaggaagaattaacgcgccggctagatcatgttcagtaaattttcagatgatgatgcgtggacaaccatatagcctttgcgtcataagttaataatgtctgtgacagtatatcatgtaaacaatcgtatgatgtggcttctctatctgccggtgatggtaatgtgacattgtagaagagggtttgtgagatacttccttcacttaacttttacgaatgaatatagacaaccacaacatccttgtcgtga

SEQ ID NO: 111 - DNA, 1059 bp, Oryza sativa
atgggcggcctctccatggaccaggcgttcgtgcaggcccccgagcaccgccccaaggcgtccgtcgccgaggccgacggcatcccggtcatcgacctctcccctctcctcgccgccggcgatggcgacgccgacggggtggacgcgctcgcggcggaggtcgggagggcgagccgggactggggcttcttcgtggtggtgcgccacggtgtgcccgcggaggcggtggcgcgcgcggcggaggcgcagaggacgttcttcgcgctgccgccggagcggagggcggccgtggcgcggagcgaggcggcgccgatggggtactacgcgtccgagcacaccaagaacgtcagggactggaaggaggtgttcgacctcgtcccgcgccagacgccgccgccgccgacgaccgccgtggccgacggcgacctggtgttcgacaacaagtggcccgacgacctgccgggattcagggaggcaatggaggagtacggcgaagcggtggaggagctggcgttcaagctgctggagctgatcgccaggagcctcggcctgagacccgaccgcctccatggcttcttcaaggacgaccagaccaccttcatccggctcaaccactaccctccctgcccgagccccgacctcgccctcggcgtcggccgccacaaggacgccggcgcgctcaccgtgctctaccaggacgatgtcggcggcctcgacgtccgccgccgatccgacggcgagtgggtgcgcgtcaggcccgtccctcactccttcatcatcaacgtcggcgacatcatccaggtgtggagcaatgacaggtacgagagcgcggagcaccgggtggcggtgaacgtggagaaggagaggttctccatccctttcttcttcaacccggcgggccacaccatggtggagccactggaggaggtcgtgagcgacgagagcccggccaggtacaacccctacaactggggcgaattcttcagcaccaggaagaacagcaacttcaagaagctggacgtggagaacgtccagatcacgcatttcaggaagaattaa

SEQ ID NO: 112 - protein, 352 aa, Oryza sativa
MGGLSMDQAFVQAPEHRPKASVAEADGIPVIDLSPLLAAGDGDADGVDALAAEVGRASRDWGFFVVVRHGVPAEAVARAAEAQRTFFALPPERRAAVARSEAAPMGYYASEHTKNVRDWKEVFDLVPRQTPPPPTTAVADGDLVFDNKWPDDLPGFREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 113 - DNA, 2027 bp, Oryza sativa
aagccacacgcacacacacacacacgctgacacacgagacgaacacttgtgctacagcttctcgccaccagctactgatcgaccatgggcggcctctccatggaccaggcgttcgtgcaggcccccgagcaccgccccaaggcgtccgtcgccgaggccgacggcatcccggtcatcgacctctcccctctcctcgccgccggcgatggcgacgccgacggggtggacgcgctcgcggcggaggtcgggagggcgagccgggactggggcttcttcgtggtggtgcgccacggtgtgcccgcggaggcggtggcgcgcgcggcggaggcgcagaggacgttcttcgcgctgccgccggagcggagggcggccgtggcgcggagcgaggcggcgccgatggggtactacgcgtccgagcacaccaagaacgtcagggactggaaggaggtgttcgacctcgtcccgcgccagacgccgccgccgccgacgaccgccgtggccgacggcgacctggtgttcgacaacaagtggcccgacgacctgccgggattcaggtcaggtcaccacatcgatcgatcgtcttcttcatcctcgcatcaattcagttcaacctcatcgaattcttgagcagggaggcaatggaggagtacggcgaagcggtggaggagctggcgttcaagctgctggagctgatcgccaggagcctcggcctgagacccgaccgcctccatggcttcttcaaggacgaccagaccaccttcatccggctcaaccactaccctccctgcccgagccccgacctcgccctcggcgtcggccgccacaaggacgccggcgcgctcaccgtgctctaccaggacgatgtcggcggcctcgacgtccgccgccgatccgacggcgagtgggtgcgcgtcaggcccgtccctcactccttcatcatcaacgtcggcgacatcatccaggtacttttttttttgagcagctacatatttatcaacaaattttcttctaacaatttatcggacataaatatattacaatgaaagaataattgtatcataacttgtgtgtccttatatgtaagttttagaaatcctatagtaacatggtattttcgcgaaagcggagattgtgagaccgtatcttttcacccatgcgcgtcatatgatttttttttcttgccaacttaaataaatttcaaagtaaatctaatagattaaaattatgtgaaacttacatataagttttctacggtaacacgctattttcacgaaacggaggtcgttccaagttgaatgaatcttgaagtaaatctaacgatttaaaattatgtgcatacacgttatattacagttatatacaagttataatataattacactacaattataacggtattcatagttgacaaacttttaaaagagaattagttaataaatatataacaacattgtagtttaattgttactatttgacatcatttttatttgcattttgaatttgactgaaaaaattgagagtgcgcttgtccaggtgtggagcaatgacaggtacgagagcgcggagcaccgggtggcggtgaacgtggagaaggagaggttctccatccctttcttcttcaacccggcgggccacaccatggtggagccactggaggaggtcgtgagcgacgagagcccggccaggtacaacccctacaactggggcgaattcttcagcaccaggaagaacagcaacttcaagaagctggacgtggagaacgtccagatcacgcatttcaggaagaattaacgcgccggctagatcatgttcagtaaattttcagatgatgatgcgtggacaaccatatagcctttgcgtcataagttaataatgtctgtgacagtatatcatgtaaacaatcgtatgatgtggcttctctatctgccggtgatggtaatgtgacattgtagaagagggtttgtgagatacttccttcacttaacttttacgaatgaatatagacaaccacaacatccttgtcgtga

SEQ ID NO: 114 - DNA, 1747 bp, Triticum aestivum
tcactcaaggccacaacacactcgccagtccatcgccaccatacgtgacaacttgagttacttgatctgttgctcatcgatctcgacatcgccatgggcggcctctccatggaccaggccttcgtgcaggcccccgagcatcgcaccaaggcgaacctcgccgacgcggccggcatcccggtcatcgacctctcccctctcgccgccggcgacaaggccggcctggacgccctcgcggccgaggtgggcagggcgagccgtgactgggggttcttcgtggtggtgcgccacggcgtgccggcggagacggtggcgcgggcgctggaggcgcagagggccttcttcgcgctgcccgcggaccggaaggcggccgtgcggagggacgaggcggcgccgctggggtactacgagtcggagcacaccaagaacgtcagggactggaaggaggtgttcgacctcgtcccccgcgagccgccgccgcctgccgcggttgccgacggcgagctcatgttcgagaacaagtggcccgaggacctgccggggttcagagaggctctcgaagagtacgagaaagcgatggaggagctggcgttcaagctgctggagctgatcgcccggagcctgggactgagaccggaccggctgcacggcttcttcaaggaccagaccaccttcatccggctgaaccactacccgccctgccccagccccgacctcgccctcggcgtcggtcgccacaaggacgccggcgcgctcaccatcctctaccaggacgacgtcggcgggctcgacgtccggcgccgctccgacggcgagtgggtgcgcgtcaggcctgtcccggactcctacgtcatcaacgtcggcgacatcatccaggtgtggagcaacgacaggtacgagagcgcggagcacagggtgtcggtgaactcgcacaaggagaggttctccatgccctacttcttcgaccccgggagcgacgccatgatcgagccgttggaggagatggtgagcgacgaaaggccggccaggtacgacgcctacaactggggcaacttcttcagcaccaggaagaacagcaacttcaggaagctcgccgtcgaaaacgtccagatcgcacacttcagaaaggaccgaccttaaatgaaggatccctcatgaattcatgatccttccgctctcctcagtgatcctagtgctacaactacaagcatctccccgtttgtagtaatcatatataaataagtattccctccgtaaactaatataagagcatttaaaacactactctagtgatctaaatgctcttatattagtttacagagagagtattgtgtattaataatgactttctctgtttcaaaataagtgatgacgtggttttagttcaattttttttagagaggaggcatctgacgggccttaaactgaggaccttagagtacaaacaaggttcgacgaaagtaagtttaagggatacaaggccgtagccaacaaaacgcgacgcagcgcgcaatctaaaatcagcgtgctgtcaaggtagctggagacgtccatgccgttaatctctctcaagaagctcgccgaagctcagtgcaccttgcgtgcactcttgtgaagagcaccttcacgtgtcctttgtcctgagattttgtcaacagtttccatgactgcaagaaaaacactagtttgtataatagctcagcgggatgtcgaatgaattgcccctcaatcaaagctttatttctag

SEQ ID NO: 115 - DNA, 1047 bp, Triticum aestivum
atgggcggcctctccatggaccaggccttcgtgcaggcccccgagcatcgcaccaaggcgaacctcgccgacgcggccggcatcccggtcatcgacctctcccctctcgccgccggcgacaaggccggcctggacgccctcgcggccgaggtgggcagggcgagccgtgactgggggttcttcgtggtggtgcgccacggcgtgccggcggagacggtggcgcgggcgctggaggcgcagagggccttcttcgcgctgcccgcggaccggaaggcggccgtgcggagggacgaggcggcgccgctggggtactacgagtcggagcacaccaagaacgtcagggactggaaggaggtgttcgacctcgtcccccgcgagccgccgccgcctgccgcggttgccgacggcgagctcatgttcgagaacaagtggcccgaggacctgccggggttcagagaggctctcgaagagtacgagaaagcgatggaggagctggcgttcaagctgctggagctgatcgcccggagcctgggactgagaccggaccggctgcacggcttcttcaaggaccagaccaccttcatccggctgaaccactacccgccctgccccagccccgacctcgccctcggcgtcggtcgccacaaggacgccggcgcgctcaccatcctctaccaggacgacgtcggcgggctcgacgtccggcgccgctccgacggcgagtgggtgcgcgtcaggcctgtcccggactcctacgtcatcaacgtcggcgacatcatccaggtgtggagcaacgacaggtacgagagcgcggagcacagggtgtcggtgaactcgcacaaggagaggttctccatgccctacttcttcgaccccgggagcgacgccatgatcgagccgttggaggagatggtgagcgacgaaaggccggccaggtacgacgcctacaactggggcaacttcttcagcaccaggaagaacagcaacttcaggaagctcgccgtcgaaaacgtccagatcgcacacttcagaaaggaccgaccttaa

SEQ ID NO: 116 - protein, 348 aa, Triticum aestivum
MGGLSMDQAFVQAPEHRTKANLADAAGIPVIDLSPLAAGDKAGLDALAAEVGRASRDWGFFVVVRHGVPAETVARALEAQRAFFALPADRKAAVRRDEAAPLGYYESEHTKNVRDWKEVFDLVPREPPPPAAVADGELMFENKWPEDLPGFREALEEYEKAMEELAFKLLELIARSLGLRPDRLHGFFKDQTTFIRLNHYPPCPSPDLALGVGRHKDAGALTILYQDDVGGLDVRRRSDGEWVRVRPVPDSYVINVGDIIQVWSNDRYESAEHRVSVNSHKERFSMPYFFDPGSDAMIEPLEEMVSDERPARYDAYNWGNFFSTRKNSNFRKLAVENVQIAHFRKDRP

SEQ ID NO: 117 - DNA, 1863 bp, Triticum aestivum
tcactcaaggccacaacacactcgccagtccatcgccaccatacgtgacaacttgagttacttgatctgttgctcatcgatctcgacatcgccatgggcggcctctccatggaccaggccttcgtgcaggcccccgagcatcgcaccaaggcgaacctcgccgacgcggccggcatcccggtcatcgacctctcccctctcgccgccggcgacaaggccggcctggacgccctcgcggccgaggtgggcagggcgagccgtgactgggggttcttcgtggtggtgcgccacggcgtgccggcggagacggtggcgcgggcgctggaggcgcagagggccttcttcgcgctgcccgcggaccggaaggcggccgtgcggagggacgaggcggcgccgctggggtactacgagtcggagcacaccaagaacgtcagggactggaaggaggtgttcgacctcgtcccccgcgagccgccgccgcctgccgcggttgccgacggcgagctcatgttcgagaacaagtggcccgaggacctgccggggttcaggtacggtcatcaactcaatcaattctgcgaccccgagagaaatggttcactattattcgtggttcatacgtatgattcagacgttaatctcgatgcaaattgatttgtgcatgcagagaggctctcgaagagtacgagaaagcgatggaggagctggcgttcaagctgctggagctgatcgcccggagcctgggactgagaccggaccggctgcacggcttcttcaaggaccagaccaccttcatccggctgaaccactacccgccctgccccagccccgacctcgccctcggcgtcggtcgccacaaggacgccggcgcgctcaccatcctctaccaggacgacgtcggcgggctcgacgtccggcgccgctccgacggcgagtgggtgcgcgtcaggcctgtcccggactcctacgtcatcaacgtcggcgacatcatccaggtgtggagcaacgacaggtacgagagcgcggagcacagggtgtcggtgaactcgcacaaggagaggttctccatgccctacttcttcgaccccgggagcgacgccatgatcgagccgttggaggagatggtgagcgacgaaaggccggccaggtacgacgcctacaactggggcaacttcttcagcaccaggaagaacagcaacttcaggaagctcgccgtcgaaaacgtccagatcgcacacttcagaaaggaccgaccttaaatgaaggatccctcatgaattcatgatccttccgctctcctcagtgatcctagtgctacaactacaagcatctccccgtttgtagtaatcatatataaataagtattccctccgtaaactaatataagagcatttaaaacactactctagtgatctaaatgctcttatattagtttacagagagagtattgtgtattaataatgactttctctgtttcaaaataagtgatgacgtggttttagttcaattttttttagagaggaggcatctgacgggccttaaactgaggaccttagagtacaaacaaggttcgacgaaagtaagtttaagggatacaaggccgtagccaacaaaacgcgacgcagcgcgcaatctaaaatcagcgtgctgtcaaggtagctggagacgtccatgccgttaatctctctcaagaagctcgccgaagctcagtgcaccttgcgtgcactcttgtgaagagcaccttcacgtgtcctttgtcctgagattttgtcaacagtttccatgactgcaagaaaaacactagtttgtataatagctcagcgggatgtcgaatgaattgcccctcaatcaaagctttatttctag

SEQ ID NO: 118 - protein, 349 aa, Hordeum vulgare
MGGLSMGQAFVQAPEHRTKPTLADADGIPVIDLSPLAAGDEAGVDALAAEVGRASRDWGFFVVVRHGVPAETVARALEAQRAFFALPAERKAAVRRDEAAPLGYYESEHTKNVRDWKEVFDFVPREPPPPAAVADGELVFENKWPEDLPGFRVAFEEYAKAMEELAFKLLELIARSLGLTPDRLNGFFKDHQTTFIRLNHYPPCPSPDLALGVGRHKDAGALTVLYQDDVGGLDVRHRSDGEWVRVRPVPDSYVINVGDIIQVWSNDRYESAEHRVSVNSDKERFSMPYFFNPGSDAMVEPLEEMVSDERPARYDAYNWGHFFSTRKNSNFKKLDVENVQIAHFRKLHL

SEQ ID NO: 119 - DNA, 1963 bp, Sorghum bicolor
tataaataccacgccatgtacttctctgcttctacacttctccagcttctctcatgccataccactagtgcaaggtcctagatttacacttggtgctacagcttcttcctccctccctcccctctctaggcagctagcacgcagcgcagcacacgaaacatctattgaccggccgcctccgccggggatccataattactatactaccaatcggccagcgtcatgccgacgccgtcgcacctcgcgaacccgcgctacttcgacttccgtgcggcgcggcgggtgccggagacgcacgcctggccggggctgcacgaccaccccgtcgtggacggcggcgcgccggggccagacgccgtccccgtggtggacctcgcgggggcggcggacgagccgagagccgcggtggtggcccaagtggcgcgcgccgccgagcaatggggcgcgttcctgctcacggggcacggcgtccccgcggagctgctggcgcgcgtcgaggaccggatcgccaccatgttcgcgctgccagcggacgacaagatgcgcgccgtgcgcgggcctggcgacgcctgcggctacggctccccgcccatctcctccttcttctccaagtgcatgtggtcggagggatacaccttctcgccggccaacctccgcgccgacctccgcaagctctggcctaaggccggcgacgactacaccagcttctgtgatgtgatggaggagttccacaagcacatgcgtgccctcgcggacaagctgctggagctgttcctcatggcgctggggctcaccgacgagcaggtcggcggcgtggaggcggagcggaggatcgccgagacgatgaccgccaccatgcacctcaactggtaccctcggtgcccggacccgcgccgcgcgctggggctgatcgcgcacaccgactcgggcttcttcaccttcgtgctgcagagcctcgtcccggggctgcagctcttccgccacgccccggaccggtgggtggcggtgccggcggtaccgggcgccttcgtcgtcaacgtgggcgacctcttccacatcctcaccaacggccggttccacagcgtgtaccaccgcgccgtcgtgaaccgggacctcgacaggatatctctcggctacttcctcggcccgccgccgcacgccaaggtggcgccgctaagggaggccgtgccgcccggccgcacccccgcgtaccgcgccgtcacgtggcccgagtacatgggcgtccgcaagaaggccttcaccaccggcgcatccgcgctcaagatggtcgccctcgccgccgccgccgccgccgccgacctcgacgatgacgccggtgctggcgccgccgccgaacctgtcgtccatcagcagctactcgtctcgtcgtagccgatcgatcgccggatcggtcgagactgatgatgatgatgcatatatactcgtcgatggagtagacagactaatcaagcaaccctgaaactatgaatgcatgcgtgcgcttcgtgcttgcttgcgcatgcagctagcaggcttcattccgttccgcagctgctctgctccaacctgctctgctggattgatgtatatggtagaagaattaagagatcgatggatgacggaggaagaagaagacgaagacgacgatgaggaaaaggacacgctgtacgtagctggttcttctagtctagtttacagcaggccgggcggccggctgctgcttccaatcgagtttgtcgttactgacgattgttagtggatcgattaactaatctggaattctggattattaatataatgcatgtggtttggcatctggcgtaaagcaggtaatggtacctagccagtagccagtagccaggctggtcaatgataggtctataccctgatcctgtactgttgtttctttcggtctttctgagagagaaaaaaaacgaatatatggcgtactcaattcatcaaa

SEQ ID NO: 120 - DNA, 1170 bp, Sorghum bicolor
atgccgacgccgtcgcacctcgcgaacccgcgctacttcgacttccgtgcggcgcggcgggtgccggagacgcacgcctggccggggctgcacgaccaccccgtcgtggacggcggcgcgccggggccagacgccgtccccgtggtggacctcgcgggggcggcggacgagccgagagccgcggtggtggcccaagtggcgcgcgccgccgagcaatggggcgcgttcctgctcacggggcacggcgtccccgcggagctgctggcgcgcgtcgaggaccggatcgccaccatgttcgcgctgccagcggacgacaagatgcgcgccgtgcgcgggcctggcgacgcctgcggctacggctccccgcccatctcctccttcttctccaagtgcatgtggtcggagggatacaccttctcgccggccaacctccgcgccgacctccgcaagctctggcctaaggccggcgacgactacaccagcttctgtgatgtgatggaggagttccacaagcacatgcgtgccctcgcggacaagctgctggagctgttcctcatggcgctggggctcaccgacgagcaggtcggcggcgtggaggcggagcggaggatcgccgagacgatgaccgccaccatgcacctcaactggtaccctcggtgcccggacccgcgccgcgcgctggggctgatcgcgcacaccgactcgggcttcttcaccttcgtgctgcagagcctcgtcccggggctgcagctcttccgccacgccccggaccggtgggtggcggtgccggcggtaccgggcgccttcgtcgtcaacgtgggcgacctcttccacatcctcaccaacggccggttccacagcgtgtaccaccgcgccgtcgtgaaccgggacctcgacaggatatctctcggctacttcctcggcccgccgccgcacgccaaggtggcgccgctaagggaggccgtgccgcccggccgcacccccgcgtaccgcgccgtcacgtggcccgagtacatgggcgtccgcaagaaggccttcaccaccggcgcatccgcgctcaagatggtcgccctcgccgccgccgccgccgccgccgacctcgacgatgacgccggtgctggcgccgccgccgaacctgtcgtccatcagcagctactcgtctcgtcgtag

SEQ ID NO: 121 - protein, 389 aa, Sorghum bicolor
MPTPSHLANPRYFDFRAARRVPETHAWPGLHDHPVVDGGAPGPDAVPVVDLAGAADEPRAAVVAQVARAAEQWGAFLLTGHGVPAELLARVEDRIATMFALPADDKMRAVRGPGDACGYGSPPISSFFSKCMWSEGYTFSPANLRADLRKLWPKAGDDYTSFCDVMEEFHKHMRALADKLLELFLMALGLTDEQVGGVEAERRIAETMTATMHLNWYPRCPDPRRALGLIAHTDSGFFTFVLQSLVPGLQLFRHAPDRWVAVPAVPGAFVVNVGDLFHILTNGRFHSVYHRAVVNRDLDRISLGYFLGPPPHAKVAPLREAVPPGRTPAYRAVTWPEYMGVRKKAFTTGASALKMVALAAAAAAADLDDDAGAGAAAEPVVHQQLLVSS

SEQ ID NO: 122 - DNA, 2321 bp, Sorghum bicolor
tataaataccacgccatgtacttctctgcttctacacttctccagcttctctcatgccataccactagtgcaaggtcctagatttacacttggtgctacagcttcttcctccctccctcccctctctaggcagctagcacgcagcgcagcacacgaaacatctattgaccggccgcctccgccggggatccataattactatactaccaatcggccagcgtcatgccgacgccgtcgcacctcgcgaacccgcgctacttcgacttccgtgcggcgcggcgggtgccggagacgcacgcctggccggggctgcacgaccaccccgtcgtggacggcggcgcgccggggccagacgccgtccccgtggtggacctcgcgggggcggcggacgagccgagagccgcggtggtggcccaagtggcgcgcgccgccgagcaatggggcgcgttcctgctcacggggcacggcgtccccgcggagctgctggcgcgcgtcgaggaccggatcgccaccatgttcgcgctgccagcggacgacaagatgcgcgccgtgcgcgggcctggcgacgcctgcggctacggctccccgcccatctcctccttcttctccaagtgcatgtggtcggagggatacaccttctcgccggccaacctccgcgccgacctccgcaagctctggcctaaggccggcgacgactacaccagcttctggtacgtgcacccgccggccgcgcgccgccacacaccgtacccacacacgtgcgcgctcgcgcctagctactagtagctgctttgctttgcttacctttgattctcgcctttgccatgcatatgcatgatgcacgtacaggtactgcaggtacaacatgtcacacgcacgcacgcacgcacaacccatagtccgatacgatacatcatcgatcgacgtgtcgtcaccgtctaaggccatgcatgcatgcaagcacacgcctagacctttttagcatgctggctgacgaggagtatactagctaataagctacttgtcactgcgcgtcttgcttaattacactagtgcatatttctacagtgatgtgatggaggagttccacaagcacatgcgtgccctcgcggacaagctgctggagctgttcctcatggcgctggggctcaccgacgagcaggtcggcggcgtggaggcggagcggaggatcgccgagacgatgaccgccaccatgcacctcaactggtaccctcggtgcccggacccgcgccgcgcgctggggctgatcgcgcacaccgactcgggcttcttcaccttcgtgctgcagagcctcgtcccggggctgcagctcttccgccacgccccggaccggtgggtggcggtgccggcggtaccgggcgccttcgtcgtcaacgtgggcgacctcttccacatcctcaccaacggccggttccacagcgtgtaccaccgcgccgtcgtgaaccgggacctcgacaggatatctctcggctacttcctcggcccgccgccgcacgccaaggtggcgccgctaagggaggccgtgccgcccggccgcacccccgcgtaccgcgccgtcacgtggcccgagtacatgggcgtccgcaagaaggccttcaccaccggcgcatccgcgctcaagatggtcgccctcgccgccgccgccgccgccgccgacctcgacgatgacgccggtgctggcgccgccgccgaacctgtcgtccatcagcagctactcgtctcgtcgtagccgatcgatcgccggatcggtcgagactgatgatgatgatgcatatatactcgtcgatggagtagacagactaatcaagcaaccctgaaactatgaatgcatgcgtgcgcttcgtgcttgcttgcgcatgcagctagcaggcttcattccgttccgcagctgctctgctccaacctgctctgctggattgatgtatatggtagaagaattaagagatcgatggatgacggaggaagaagaagacgaagacgacgatgaggaaaaggacacgctgtacgtagctggttcttctagtctagtttacagcaggccgggcggccggctgctgcttccaatcgagtttgtcgttactgacgattgttagtggatcgattaactaatctggaattctggattattaatataatgcatgtggtttggcatctggcgtaaagcaggtaatggtacctagccagtagccagtagccaggctggtcaatgataggtctataccctgatcctgtactgttgtttctttcggtctttctgagagagaaaaaaaacgaatatatggcgtactcaattcatcaaa

SEQ ID NO: 123 - DNA, 1796 bp, Setaria italica
actagtgcaaggtcctagatttacacttggtgcttgcttgtttcttcctagttgctactggtagcacgcagtggctggctggccgtaatctattgtctgggctcgatcggtgattaggaagtagccaaagcaagctaaggccgccgccgccgccgccatgccgacgccgtcgcacctcaagaacccgctctacttcgacttccgcgccgcgcggcgggtgccggagtcccacgcctggccggggctcgacgaccaccccgtggtggacggcggcggcgcgccggggtccccggacgccgtgccggtggtggacctgcgcgagccgggcgccgcggcggtggcccgcgtggcgcgcgccgccgagcagtggggcgcgttcctgctcaccggccacggcgtccccgcggagctcctggcgcgcgtcgaggaccgcgtcgcgtgcatgttcgcgctgccggccgccgacaagatgcgcgccgtgcgcgggccgggggacgcctgcggctacggctcgccgcccatctcctccttcttctccaagtgcatgtggtccgagggctacaccttctcgccggcctccctccgccgcgacctccgcaagctctggcccaaggccggcgacgactacgacagcttctgtgacgtgatggaggagttccacaaggagatgcgcgccctcgccgacaggctcctggagctgttcctcagggcgctcgggctcaccggcgagcaggtcggcgccgtcgaggcggagcggaggatcggcgagacgatgaccgccaccatgcacctcaactggtatccgaggtgcccggacccgcggcgcgcgctggggctgatcgcgcacacggactcgggcttcttcaccttcgtgctgcagagcctcgtgccggggctgcagctgttccggcacggccccaaccggtgggtggcggtgccggccgtgccgggcgccttcgtcgtcaacgtcggcgacctcttccacatcctcacgaacggccgcttccacagcgtgtaccaccgcgccgtcgtcaaccgggacctcgaccggatatcgctcggctacttcctcggcccgccgccccacgccaaggtggcgccgctccgggaggtcgtgccgccgggccgggcccccgcctaccgcgccgtcacgtggcccgagtacatgggcgtccgcaagaaggccttcaccaccggcgcctccgcgctcaagatggtcgccgccgccgccgccgccaccgaatccgacgacaccgacgcagccgccgccgccgttcaccagccgccggtcgtcgtctcatcgtagccgatcgatcgccggaaacacagacgatgcataccgtaccccgagcaatctaatcaaaacaaggcatccattctcgcgcgcatgcagcggccagccgggcttccgcagctgctcggcctcctctgctggctgtggaaatggaaaattttaatctgagatgaagacgaagacgaagacgaaacggagaggaaaaggacatgctgtagctgtttcttctagttgcgcaggccgctcccagtcgagtttgtcgttactgacgattattactctgatgaaaactaatctgaattaatgcatgtagtttggcaatttggtactaaaggtaggcacctagccaggctggtcaatgataggtctataacctgatcctgttctctgttgttttcctttgtctgagaaaaaatggaaataattgatccggccggacgggtgtactgataggtgatgctgaattgctgatgcaagaggttgcgagctgcagtgagcagca

SEQ ID NO: 124 - DNA, 1149 bp, Setaria italica
atgccgacgccgtcgcacctcaagaacccgctctacttcgacttccgcgccgcgcggcgggtgccggagtcccacgcctggccggggctcgacgaccaccccgtggtggacggcggcggcgcgccggggtccccggacgccgtgccggtggtggacctgcgcgagccgggcgccgcggcggtggcccgcgtggcgcgcgccgccgagcagtggggcgcgttcctgctcaccggccacggcgtccccgcggagctcctggcgcgcgtcgaggaccgcgtcgcgtgcatgttcgcgctgccggccgccgacaagatgcgcgccgtgcgcgggccgggggacgcctgcggctacggctcgccgcccatctcctccttcttctccaagtgcatgtggtccgagggctacaccttctcgccggcctccctccgccgcgacctccgcaagctctggcccaaggccggcgacgactacgacagcttctgtgacgtgatggaggagttccacaaggagatgcgcgccctcgccgacaggctcctggagctgttcctcagggcgctcgggctcaccggcgagcaggtcggcgccgtcgaggcggagcggaggatcggcgagacgatgaccgccaccatgcacctcaactggtatccgaggtgcccggacccgcggcgcgcgctggggctgatcgcgcacacggactcgggcttcttcaccttcgtgctgcagagcctcgtgccggggctgcagctgttccggcacggccccaaccggtgggtggcggtgccggccgtgccgggcgccttcgtcgtcaacgtcggcgacctcttccacatcctcacgaacggccgcttccacagcgtgtaccaccgcgccgtcgtcaaccgggacctcgaccggatatcgctcggctacttcctcggcccgccgccccacgccaaggtggcgccgctccgggaggtcgtgccgccgggccgggcccccgcctaccgcgccgtcacgtggcccgagtacatgggcgtccgcaagaaggccttcaccaccggcgcctccgcgctcaagatggtcgccgccgccgccgccgccaccgaatccgacgacaccgacgcagccgccgccgccgttcaccagccgccggtcgtcgtctcatcgtag

SEQ ID NO: 125 - protein, 382 aa, Setaria italica
MPTPSHLKNPLYFDFRAARRVPESHAWPGLDDHPVVDGGGAPGSPDAVPVVDLREPGAAAVARVARAAEQWGAFLLTGHGVPAELLARVEDRVACMFALPAADKMRAVRGPGDACGYGSPPISSFFSKCMWSEGYTFSPASLRRDLRKLWPKAGDDYDSFCDVMEEFHKEMRALADRLLELFLRALGLTGEQVGAVEAERRIGETMTATMHLNWYPRCPDPRRALGLIAHTDSGFFTFVLQSLVPGLQLFRHGPNRWVAVPAVPGAFVVNVGDLFHILTNGRFHSVYHRAVVNRDLDRISLGYFLGPPPHAKVAPLREVVPPGRAPAYRAVTWPEYMGVRKKAFTTGASALKMVAAAAAATESDDTDAAAAAVHQPPVVVSS

SEQ ID NO: 126 - DNA, 2146 bp, Setaria italica
actagtgcaaggtcctagatttacacttggtgcttgcttgtttcttcctagttgctactggtagcacgcagtggctggctggccgtaatctattgtctgggctcgatcggtgattaggaagtagccaaagcaagctaaggccgccgccgccgccgccatgccgacgccgtcgcacctcaagaacccgctctacttcgacttccgcgccgcgcggcgggtgccggagtcccacgcctggccggggctcgacgaccaccccgtggtggacggcggcggcgcgccggggtccccggacgccgtgccggtggtggacctgcgcgagccgggcgccgcggcggtggcccgcgtggcgcgcgccgccgagcagtggggcgcgttcctgctcaccggccacggcgtccccgcggagctcctggcgcgcgtcgaggaccgcgtcgcgtgcatgttcgcgctgccggccgccgacaagatgcgcgccgtgcgcgggccgggggacgcctgcggctacggctcgccgcccatctcctccttcttctccaagtgcatgtggtccgagggctacaccttctcgccggcctccctccgccgcgacctccgcaagctctggcccaaggccggcgacgactacgacagcttctggtacgtcgtcgtctatagctagtagctagccgccggcacacgtgcgcctgacctgctccgccatgcatggtgcacgtatgcagatcgatcacacgcaccgatcgatcgacgtgtcccggtcaaggccatgcatgcatgcaagcaaccaacagcacgcctcctgatactgcttgttgcttacaccgttggtatgtgcctgttgcctacagtgacgtgatggaggagttccacaaggagatgcgcgccctcgccgacaggctcctggagctgttcctcagggcgctcgggctcaccggcgagcaggtcggcgccgtcgaggcggagcggaggatcggcgagacgatgaccgccaccatgcacctcaactggtatgtgccatgccatgaccacctgcgtctatgaactaacggaagcttccatcgcgtgtccatgacgatttagaagctgtagtccagagcttgagacaaacgaaacgaagcttacatggtggcgtgacgtgtcgcgtgcaggtatccgaggtgcccggacccgcggcgcgcgctggggctgatcgcgcacacggactcgggcttcttcaccttcgtgctgcagagcctcgtgccggggctgcagctgttccggcacggccccaaccggtgggtggcggtgccggccgtgccgggcgccttcgtcgtcaacgtcggcgacctcttccacatcctcacgaacggccgcttccacagcgtgtaccaccgcgccgtcgtcaaccgggacctcgaccggatatcgctcggctacttcctcggcccgccgccccacgccaaggtggcgccgctccgggaggtcgtgccgccgggccgggcccccgcctaccgcgccgtcacgtggcccgagtacatgggcgtccgcaagaaggccttcaccaccggcgcctccgcgctcaagatggtcgccgccgccgccgccgccaccgaatccgacgacaccgacgcagccgccgccgccgttcaccagccgccggtcgtcgtctcatcgtagccgatcgatcgccggaaacacagacgatgcataccgtaccccgagcaatctaatcaaaacaaggcatccattctcgcgcgcatgcagcggccagccgggcttccgcagctgctcggcctcctctgctggctgtggaaatggaaaattttaatctgagatgaagacgaagacgaagacgaaacggagaggaaaaggacatgctgtagctgtttcttctagttgcgcaggccgctcccagtcgagtttgtcgttactgacgattattactctgatgaaaactaatctgaattaatgcatgtagtttggcaatttggtactaaaggtaggcacctagccaggctggtcaatgataggtctataacctgatcctgttctctgttgttttcctttgtctgagaaaaaatggaaataattgatccggccggacgggtgtactgataggtgatgctgaattgctgatgcaagaggttgcgagctgcagtgagcagca

SEQ ID NO: 127 - DNA, 1933 bp, Oryza sativa
actactcattccactattgtaaagtcatagaaaaaatttatatagagagaaaaaattagtgttgttattgttactggctttctgccagacgagacgagcgagcgcgcgagtgtgttgctctctggtcatcgtcgtcgtcgtcgcgatgccgacgccgtcgcacttgaagaacccgctctgcttcgacttccgggcggcgaggcgggtgccggagacgcacgcgtggccggggctggacgaccacccggtggtggacggcggcggcggcggcggcgaggacgcggtgccggtggtggacgtcggggcgggcgacgcggcggcgcgggtggcgcgggcggcggagcagtggggcgcgttccttctggtcgggcacggcgtgccggcggcgctgctgtcgcgcgtcgaggagcgcgtcgcccgcgtgttctccctgccggcgtcggagaagatgcgcgccgtccgcggccccggcgagccctgcggctacggctcgccgcccatctcctccttcttctccaagctcatgtggtccgagggctacaccttctccccttcctccctccgctccgagctccgccgcctctggcccaagtccggcgacgactacctcctcttctgtgacgtgatggaggagtttcacaaggagatgcggcggctagccgacgagttgctgaggttgttcttgagggcgctggggctcaccggcgaggaggtcgccggagtcgaggcggagaggaggatcggcgagaggatgacggcgacggtgcacctcaactggtacccgaggtgcccggagccgcggcgagcgctggggctcatcgcgcacacggactcgggcttcttcaccttcgtgctccagagcctcgtcccggggctgcagctgttccgtcgagggcccgaccggtgggtggcggtgccggcggtggcgggggccttcgtcgtcaacgtcggcgacctcttccacatcctcaccaacggccgcttccacagcgtctaccaccgcgccgtcgtgaaccgcgaccgcgaccgggtctcgctcggctacttcctcggcccgccgccggacgccgaggtggcgccgctgccggaggccgtgccggccggccggagccccgcctaccgcgctgtcacgtggccggagtacatggccgtccgcaagaaggccttcgccaccggcggctccgccctcaagatggtctccaccgacgccgccgccgccgccgacgaacacgacgacgtcgccgccgccgccgacgtccacgcataagctatagctactagctacctcgatctcacgcaaaaaaaaaaagaaacaattaatagagcaaaaaaaaaaagaagagaaaatggtggtacttgtgtttaaggtttcctccatgcaaaatggtttgcatgcatgcatgcaaagctagcatctgcagctgcaagaattacaagagcagagaagcagacagctagatggagataattaattaattaattaatctaattaagcatgcaataattaagattattattctgatttcagaactgaaaaaaaaagtgtggttaattaattattggttaggcttaattttatctagatgtagaaaaagaatcaagatcttcaagcaagagagaagaggatcgaagaagaaggaaaagaaaacgaaaaggacatgctgtgttgtctcttctagttgtaccctggctgctgattaagtgctttgttttgttgctgcaagcttgtcgttactgattattagttagttatgcatctaattgattaaactaatctgtttggcattttggctcgagctaagctatagccaggctggtcaatgataggaacttgtacaatttaagcaattgaacctgatcctgtactggcatgtatgtatatatgcaagtgatgagaaccactagctagtatagctagacatgtatttgtata

SEQ ID NO: 128 - DNA, 1122 bp, Oryza sativa
atgccgacgccgtcgcacttgaagaacccgctctgcttcgacttccgggcggcgaggcgggtgccggagacgcacgcgtggccggggctggacgaccacccggtggtggacggcggcggcggcggcggcgaggacgcggtgccggtggtggacgtcggggcgggcgacgcggcggcgcgggtggcgcgggcggcggagcagtggggcgcgttccttctggtcgggcacggcgtgccggcggcgctgctgtcgcgcgtcgaggagcgcgtcgcccgcgtgttctccctgccggcgtcggagaagatgcgcgccgtccgcggccccggcgagccctgcggctacggctcgccgcccatctcctccttcttctccaagctcatgtggtccgagggctacaccttctccccttcctccctccgctccgagctccgccgcctctggcccaagtccggcgacgactacctcctcttctgtgacgtgatggaggagtttcacaaggagatgcggcggctagccgacgagttgctgaggttgttcttgagggcgctggggctcaccggcgaggaggtcgccggagtcgaggcggagaggaggatcggcgagaggatgacggcgacggtgcacctcaactggtacccgaggtgcccggagccgcggcgagcgctggggctcatcgcgcacacggactcgggcttcttcaccttcgtgctccagagcctcgtcccggggctgcagctgttccgtcgagggcccgaccggtgggtggcggtgccggcggtggcgggggccttcgtcgtcaacgtcggcgacctcttccacatcctcaccaacggccgcttccacagcgtctaccaccgcgccgtcgtgaaccgcgaccgcgaccgggtctcgctcggctacttcctcggcccgccgccggacgccgaggtggcgccgctgccggaggccgtgccggccggccggagccccgcctaccgcgctgtcacgtggccggagtacatggccgtccgcaagaaggccttcgccaccggcggctccgccctcaagatggtctccaccgacgccgccgccgccgccgacgaacacgacgacgtcgccgccgccgccgacgtccacgcataa

SEQ ID NO: 129 - protein, 373 aa, Oryza sativa
MPTPSHLKNPLCFDFRAARRVPETHAWPGLDDHPVVDGGGGGGEDAVPVVDVGAGDAAARVARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPDRWVAVPAVAGAFVVNVGDLFHILTNGRFHSVYHRAVVNRDRDRVSLGYFLGPPPDAEVAPLPEAVPAGRSPAYRAVTWPEYMAVRKKAFATGGSALKMVSTDAAAAADEHDDVAAAADVHA

SEQ ID NO: 130 - DNA, 2040 bp, Oryza sativa
actactcattccactattgtaaagtcatagaaaaaatttatatagagagaaaaaattagtgttgttattgttactggctttctgccagacgagacgagcgagcgcgcgagtgtgttgctctctggtcatcgtcgtcgtcgtcgcgatgccgacgccgtcgcacttgaagaacccgctctgcttcgacttccgggcggcgaggcgggtgccggagacgcacgcgtggccggggctggacgaccacccggtggtggacggcggcggcggcggcggcgaggacgcggtgccggtggtggacgtcggggcgggcgacgcggcggcgcgggtggcgcgggcggcggagcagtggggcgcgttccttctggtcgggcacggcgtgccggcggcgctgctgtcgcgcgtcgaggagcgcgtcgcccgcgtgttctccctgccggcgtcggagaagatgcgcgccgtccgcggccccggcgagccctgcggctacggctcgccgcccatctcctccttcttctccaagctcatgtggtccgagggctacaccttctccccttcctccctccgctccgagctccgccgcctctggcccaagtccggcgacgactacctcctcttctggtatatatacatatatactctcccatgcattccatgcacatacactctacgtatatatctacctctacgtatatatctacgtattgatctacgtataatatacgcagtgacgtgatggaggagtttcacaaggagatgcggcggctagccgacgagttgctgaggttgttcttgagggcgctggggctcaccggcgaggaggtcgccggagtcgaggcggagaggaggatcggcgagaggatgacggcgacggtgcacctcaactggtacccgaggtgcccggagccgcggcgagcgctggggctcatcgcgcacacggactcgggcttcttcaccttcgtgctccagagcctcgtcccggggctgcagctgttccgtcgagggcccgaccggtgggtggcggtgccggcggtggcgggggccttcgtcgtcaacgtcggcgacctcttccacatcctcaccaacggccgcttccacagcgtctaccaccgcgccgtcgtgaaccgcgaccgcgaccgggtctcgctcggctacttcctcggcccgccgccggacgccgaggtggcgccgctgccggaggccgtgccggccggccggagccccgcctaccgcgctgtcacgtggccggagtacatggccgtccgcaagaaggccttcgccaccggcggctccgccctcaagatggtctccaccgacgccgccgccgccgccgacgaacacgacgacgtcgccgccgccgccgacgtccacgcataagctatagctactagctacctcgatctcacgcaaaaaaaaaaagaaacaattaatagagcaaaaaaaaaaagaagagaaaatggtggtacttgtgtttaaggtttcctccatgcaaaatggtttgcatgcatgcatgcaaagctagcatctgcagctgcaagaattacaagagcagagaagcagacagctagatggagataattaattaattaattaatctaattaagcatgcaataattaagattattattctgatttcagaactgaaaaaaaaagtgtggttaattaattattggttaggcttaattttatctagatgtagaaaaagaatcaagatcttcaagcaagagagaagaggatcgaagaagaaggaaaagaaaacgaaaaggacatgctgtgttgtctcttctagttgtaccctggctgctgattaagtgctttgttttgttgctgcaagcttgtcgttactgattattagttagttatgcatctaattgattaaactaatctgtttggcattttggctcgagctaagctatagccaggctggtcaatgataggaacttgtacaatttaagcaattgaacctgatcctgtactggcatgtatgtatatatgcaagtgatgagaaccactagctagtatagctagacatgtatttgtata

SEQ ID NO: 131 - DNA, 1332 bp, Hordeum vulgare
acactcactcctcaatccatccgtctccaccattgctcgctagctcgagctctactagctagcactgcaaagtcagccgggccggagttgatttggtccttgttagcttgaccgatcgtatacgtatcgccaggatgccgacgccgtcgcacctgagcaaggacccgcactacttcgacttccgggcggcgcggcgggtgccggagacacacgcgtggccggggctgcacgaccacccggtggtggacggcggcggcgcgggcggagggccggacgcggtgccggtggtggacatgcgcgacccgtgcgccgcggaggcggtggcgctggccgcgcaggactggggcgccttcctcttgcagggccacggcgtcccgttggagctgctggcccgcgtggaggccgcgatagcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctgtgccgtgatggaggagttccacagggagatgcgcgttctggccgacaagctgctggagctgttcctggtggccctcgggctcaccggcgagcaggtcgccgccgtcgagtcggagcacaagatcgccgagaccatgaccgccacaatgcacctcaactggtaccccaagtgcccggacccgaagcgagcgctgggcctgatcgcgcacacggactcgggcttcttcaccttcgtgctccagagcctggtgcccgggctgcagctgttccggcacggccccgaccgttgggtgacggtgcccgccgtgccgggcgccatggtcgtcaacgtcggcgacctcttccacatcctcaccaatggccgcttccacagcgtctaccaccgcgccgtcgtcaaccgcgacagcgaccggatatcgctggggtacttcctcggcccgcccgcccacgttaaggtggcgccgctcagggaggccctcgccggcacgcccgctgcctaccgcgccgtcacgtggcccgagtacatgggcgtgcgcaagaaggccttcaccaccggcgcctccgcgctcaagatggtcgccatctccaccgacgacgccgccgacgtcctccccgacgtcctctcgtcgtagatcggcgccggccatcacccggccggccaagagaccgatctatacaaacaattagtgaacaaaaaaaaaaaaaaaaaaaaaaaaaaaa

SEQ ID NO: 132 - DNA, 1110 bp, Hordeum vulgare
atgccgacgccgtcgcacctgagcaaggacccgcactacttcgacttccgggcggcgcggcgggtgccggagacacacgcgtggccggggctgcacgaccacccggtggtggacggcggcggcgcgggcggagggccggacgcggtgccggtggtggacatgcgcgacccgtgcgccgcggaggcggtggcgctggccgcgcaggactggggcgccttcctcttgcagggccacggcgtcccgttggagctgctggcccgcgtggaggccgcgatagcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctgtgccgtgatggaggagttccacagggagatgcgcgttctggccgacaagctgctggagctgttcctggtggccctcgggctcaccggcgagcaggtcgccgccgtcgagtcggagcacaagatcgccgagaccatgaccgccacaatgcacctcaactggtaccccaagtgcccggacccgaagcgagcgctgggcctgatcgcgcacacggactcgggcttcttcaccttcgtgctccagagcctggtgcccgggctgcagctgttccggcacggccccgaccgttgggtgacggtgcccgccgtgccgggcgccatggtcgtcaacgtcggcgacctcttccacatcctcaccaatggccgcttccacagcgtctaccaccgcgccgtcgtcaaccgcgacagcgaccggatatcgctggggtacttcctcggcccgcccgcccacgttaaggtggcgccgctcagggaggccctcgccggcacgcccgctgcctaccgcgccgtcacgtggcccgagtacatgggcgtgcgcaagaaggccttcaccaccggcgcctccgcgctcaagatggtcgccatctccaccgacgacgccgccgacgtcctccccgacgtcctctcgtcgtag

SEQ ID NO: 133 - protein, 369 aa, Hordeum vulgare
MPTPSHLSKDPHYFDFRAARRVPETHAWPGLHDHPVVDGGGAGGGPDAVPVVDMRDPCAAEAVALAAQDWGAFLLQGHGVPLELLARVEAAIAGMFALPASEKMRAVRRPGDSCGYGSPPISSFFSKCMWSEGYTFSPANLRSDLRKLWPKAGHDYRHFCAVMEEFHREMRVLADKLLELFLVALGLTGEQVAAVESEHKIAETMTATMHLNWYPKCPDPKRALGLIAHTDSGFFTFVLQSLVPGLQLFRHGPDRWVTVPAVPGAMVVNVGDLFHILTNGRFHSVYHRAVVNRDSDRISLGYFLGPPAHVKVAPLREALAGTPAAYRAVTWPEYMGVRKKAFTTGASALKMVAISTDDAADVLPDVLSS

SEQ ID NO: 134 - DNA, 1653 bp, Triticum aestivum
  misc_feature (1594)..(1600): n is a, c, g, or t
  misc_feature (1641)..(1641): n is a, c, g, or t
cacgagatccatccgtctccaccattgctcgctagctcgagctcctagctagtactgcaaagtcagccggggagttgatttggtccttcttggcttgaccgatcgtacgtgccgccaggatgccgacgccggcgcacctgagcaaggacccgcgctacttcgacttccgggcggcgcggcgggtgccggagacgcacgcgtggcccgggctgcacgaccaccccgtggtggacggcagcggcgcgggcggagggccggacgcggtgccggtggtggacatgcgcgacccgtgcgcggcggaggcggtggcgctggcggcgcaggactggggcgccttcctcctggagggccacggcgtcccgttggagctgctggcgcgcgtggaggccgcgatcgcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctgcgccgtgatggaggagttccacagggagatgcgcgcgctggccgacaagctgctggagctgttcctggtggccctcgggctcaccggcgagcaggtcgccgccgtcgagtccgagcagaagatcgccgagaccatgaccgccacaatgcacctcaactggtaccccaagtgcccggacccgaagcgggcgctgggcctgatcgcgcacacggactcgggcttcttcaccttcgtgctgcagagccttgtgcccgggctgcagctgttccggcacggccccgaccggtgggtgacggtgcccgccgtgccgggggccatggtcgtcaacgtcggcgacctcttccagatcctcaccaacggccgcttccacagcgtctaccaccgcgccgtcgtcaaccgcgacagcgaccggatatcgctcggctacttcctcggcccgcccgcccacgtcaaggtggcgccgctcagggaggccctggccggcacgcccgccgcctaccgcgccgtcacgtggcccgagtacatgggcgtgcgcaagaaggccttcaccaccggcgcctccgcgctcaagatggtcgccatctccactgacaacgacgccgccaaccacacggacgacctgatctcgtcgtagatcggcgccggccatcaccggccggccaagggatcgatctacacacacaattagtgaacaaaaaaatgccagagatggtgcatggtgggctggtagcttagctgaggtagctaggaggaagagcgcgcgtgcggctgtcgttcgtgcggctgttcccgcaaaaaaaaaaaaggtttcctccatatatgtctccatgcagaactgcagatgctggtggtggatgcgtccatgcagcagggaacgaactaattgtaagaaaatcaagcaaacttagttctacatctgtaattaagtatgcatgccacttggtttaattcaattcaagtgcagaaaaaattatgatgggaaaaaaaaagacatgnnnnnnnaaaaaaaaaaaaaaaaaaaaaaaaaaaaaaaaaaaaaaaanaaaaaaaaaaaa

SEQ ID NO: 135 - DNA, 1113 bp, Triticum aestivum
atgccgacgccggcgcacctgagcaaggacccgcgctacttcgacttccgggcggcgcggcgggtgccggagacgcacgcgtggcccgggctgcacgaccaccccgtggtggacggcagcggcgcgggcggagggccggacgcggtgccggtggtggacatgcgcgacccgtgcgcggcggaggcggtggcgctggcggcgcaggactggggcgccttcctcctggagggccacggcgtcccgttggagctgctggcgcgcgtggaggccgcgatcgcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctgcgccgtgatggaggagttccacagggagatgcgcgcgctggccgacaagctgctggagctgttcctggtggccctcgggctcaccggcgagcaggtcgccgccgtcgagtccgagcagaagatcgccgagaccatgaccgccacaatgcacctcaactggtaccccaagtgcccggacccgaagcgggcgctgggcctgatcgcgcacacggactcgggcttcttcaccttcgtgctgcagagccttgtgcccgggctgcagctgttccggcacggccccgaccggtgggtgacggtgcccgccgtgccgggggccatggtcgtcaacgtcggcgacctcttccagatcctcaccaacggccgcttccacagcgtctaccaccgcgccgtcgtcaaccgcgacagcgaccggatatcgctcggctacttcctcggcccgcccgcccacgtcaaggtggcgccgctcagggaggccctggccggcacgcccgccgcctaccgcgccgtcacgtggcccgagtacatgggcgtgcgcaagaaggccttcaccaccggcgcctccgcgctcaagatggtcgccatctccactgacaacgacgccgccaaccacacggacgacctgatctcgtcgtag

SEQ ID NO: 136 - protein, 370 aa, Triticum aestivum
MPTPAHLSKDPRYFDFRAARRVPETHAWPGLHDHPVVDGSGAGGGPDAVPVVDMRDPCAAEAVALAAQDWGAFLLEGHGVPLELLARVEAAIAGMFALPASEKMRAVRRPGDSCGYGSPPISSFFSKCMWSEGYTFSPANLRSDLRKLWPKAGHDYRHFCAVMEEFHREMRALADKLLELFLVALGLTGEQVAAVESEQKIAETMTATMHLNWYPKCPDPKRALGLIAHTDSGFFTFVLQSLVPGLQLFRHGPDRWVTVPAVPGAMVVNVGDLFQILTNGRFHSVYHRAVVNRDSDRISLGYFLGPPAHVKVAPLREALAGTPAAYRAVTWPEYMGVRKKAFTTGASALKMVAISTDNDAANHTDDLISS

SEQ ID NO: 137 - DNA, 1884 bp, Triticum aestivum
tatatatacagctccttgtacttctctcgttcttacactcactcctcaatccatccgtctccaccattgctcgctagctcgagctcctagctagtactgcaaagtcagccggggagttgatttggtccttcttggcttgaccgatcgtacgtgccgccaggatgccgacgccggcgcacctgagcaaggacccgcgctacttcgacttccgggcggcgcggcgggtgccggagacgcacgcgtggcccgggctgcacgaccaccccgtggtggacggcagcggcgcgggcggagggccggacgcggtgccggtggtggacatgcgcgacccgtgcgcggcggaggcggtggcgctggcggcgcaggactggggcgccttcctcctggagggccacggcgtcccgttggagctgctggcgcgcgtggaggccgcgatcgcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctggtacgtacgccggccgccgatgcgcatatacacgtcatagtacggcacctacctaactggctctggccaaccgtccgtacacacgtgaaggggcgacgtgtccgactccgaccatgcatgcatgcacgcgcgcgaaacttgttactcctgttctgctatggcagcagctagccgcgtgtgtccgttcgtaggagtagttacttacacagttacacttacgccgtccgtcgtgttcctcgacgtgcagcgccgtgatggaggagttccacagggagatgcgcgcgctggccgacaagctgctggagctgttcctggtggccctcgggctcaccggcgagcaggtcgccgccgtcgagtccgagcagaagatcgccgagaccatgaccgccacaatgcacctcaactggtacgttccactactactccagtagtacaagtacaatatatagaatacaaatggcagcagccacgacgacacgtactccaccatgcagcaaagcatatattgtcggtgcggcggttgacacggagttgtgtcgtgtcgttgattcacaggtaccccaagtgcccggacccgaagcgggcgctgggcctgatcgcgcacacggactcgggcttcttcaccttcgtgctgcagagccttgtgcccgggctgcagctgttccggcacggccccgaccggtgggtgacggtgcccgccgtgccgggggccatggtcgtcaacgtcggcgacctcttccagatcctcaccaacggccgcttccacagcgtctaccaccgcgccgtcgtcaaccgcgacagcgaccggatatcgctcggctacttcctcggcccgcccgcccacgtcaaggtggcgccgctcagggaggccctggccggcacgcccgccgcctaccgcgccgtcacgtggcccgagtacatgggcgtgcgcaagaaggccttcaccaccggcgcctccgcgctcaagatggtcgccatctccactgacaacgacgccgccaaccacacggacgacctgatctcgtcgtagatcggcgccggccatcaccggccggccaagggatcgatctacacacacaattagtgaacaaaaaaatgccagagatggtgcatggtgggctggtagcttagctgaggtagctaggaggaagagcgcgcgtgcggctgtcgttcgtgcggctgttcccgcaaaaaaaaaaaggtttcctccatatakgtccccakscaaaatsgmaawgctgggg

SEQ ID NO: 138 - RNA, 20 nt, Artificial Sequence
  suppression oligo
acggguucuuccaggugugc

SEQ ID NO: 139 - RNA, 20 nt, Artificial Sequence
  suppression oligo
cacggguucuuccaggugug

SEQ ID NO: 140 - RNA, 20 nt, Artificial Sequence
  suppression oligo
cauugaccuccccgcuggca

SEQ ID NO: 141 - RNA, 20 nt, Artificial Sequence
  suppression oligo
ccagcggggaggucaaugcu

SEQ ID NO: 142 - RNA, 20 nt, Artificial Sequence
  suppression oligo
cccagcauugaccuccccgc

SEQ ID NO: 143 - RNA, 20 nt, Artificial Sequence
  suppression oligo
cgcgcucguguacccggaca

SEQ ID NO: 144 - RNA, 20 nt, Artificial Sequence
  suppression oligo
cucccggcgcaggucgaaca

SEQ ID NO: 145 - RNA, 20 nt, Artificial Sequence
  suppression oligo
guguacccggacacggugcc

SEQ ID NO: 146 - RNA, 20 nt, Artificial Sequence
  suppression oligo
ugcagggaagcuguccgggc

SEQ ID NO: 147 - RNA, 20 nt, Artificial Sequence
  suppression oligo
uucuuccaggugugcgggca

SEQ ID NO: 148 - RNA, 20 nt, Artificial Sequence
  suppression oligo
agauccccgcgccauuccug

SEQ ID NO: 149 - RNA, 20 nt, Artificial Sequence
  suppression oligo
augcagggaagcuguccggg

SEQ ID NO: 150 - RNA, 20 nt, Artificial Sequence
  suppression oligo
auuccuguggccgcaggaag

SEQ ID NO: 151 - RNA, 20 nt, Artificial Sequence
  suppression oligo
cagcggggaggucaaugcug

SEQ ID NO: 152 - RNA, 20 nt, Artificial Sequence
  suppression oligo
caggaauggcgcggggaucu

SEQ ID NO: 153 - RNA, 20 nt, Artificial Sequence
  suppression oligo
gacuacuucgucggcacccu

SEQ ID NO: 154 - RNA, 20 nt, Artificial Sequence
  suppression oligo
gccaggauuucgagccaaug

SEQ ID NO: 155 - RNA, 20 nt, Artificial Sequence
  suppression oligo
ggaacauuuggagggaggcg

SEQ ID NO: 156 - RNA, 20 nt, Artificial Sequence
  suppression oligo
gggaggucaaugcuggggcu

SEQ ID NO: 157 - RNA, 20 nt, Artificial Sequence
  suppression oligo
uuggcucgaaauccuggccg

SEQ ID NO: 158 - RNA, 20 nt, Artificial Sequence
  suppression oligo
acggguucuuccaggugugc

SEQ ID NO: 159 - RNA, 20 nt, Artificial Sequence
  suppression oligo
cacggguucuuccaggugug

SEQ ID NO: 160 - RNA, 20 nt, Artificial Sequence
  suppression oligo
cauugaccuccccgcuggca

SEQ ID NO: 161 - RNA, 20 nt, Artificial Sequence
  suppression oligo
ccagcggggaggucaaugcu

SEQ ID NO: 162 - RNA, 20 nt, Artificial Sequence
  suppression oligo
cccagcauugaccuccccgc

SEQ ID NO: 163 - RNA, 20 nt, Artificial Sequence
  suppression oligo
cgcgcucguguacccggaca

SEQ ID NO: 164 - RNA, 20 nt, Artificial Sequence
  suppression oligo
cucccggcgcaggucgaaca

SEQ ID NO: 165 - RNA, 20 nt, Artificial Sequence
  suppression oligo
guguacccggacacggugcc

SEQ ID NO: 166 - RNA, 20 nt, Artificial Sequence
  suppression oligo
ugcagggaagcuguccgggc

SEQ ID NO: 167 - RNA, 20 nt, Artificial Sequence
  suppression oligo
uucuuccaggugugcgggca

SEQ ID NO: 168 - protein, 358 aa, Physcomitrella patens
MPKPCDACHVSSAAVFCRADAAYLCVGCDGKVHGANKLASRHERVWMCEVCEVAPAVVTCKADAASLCVACDTDIHSANPLAQRHERVPVTPLFESASPLRGPDFCVLVSENGCHDLLKGCEDASVVEAVSWLLPHPKISTNSIIRGSAAADEMGSSPFHDRPFSPKPKKQKVELPADIFSDVDPFLDLDDATVTGIQPDSLVPVHMPECSEDTDSLAHSMDPSFTKFPLSAKSGYSYGTSTLTQSISCSSLDAAVVPDSSLSDISTPYLDSQSSQDMSARLPHQTGGPIDTVDREARVLRYKEKRQKRKFEKTIRYASRKAYAESRPRIKGRFAKRTDSDMEQFGSVDSSFGVVPSF

SEQ ID NO: 169 - DNA, 1077 bp, Physcomitrella patens
atgccgaagccttgtgatgcatgccatgtttccagcgcggcggtgttctgccgagcggacgctgcctacctgtgcgtaggctgcgatgggaaggtccacggggccaacaaactagcgtctcgacacgagcgcgtgtggatgtgcgaagtgtgcgaggttgctccagccgtggtgacctgcaaggcggatgcggcttctctctgtgtggcctgtgacacagacatccactccgccaacccgctagcgcagcgtcacgagagagtgccggtgacacctctgttcgagagtgcgagtcctttgcgtgggccagatttctgcgtgttggtgtcagagaatgggtgccatgatctgctgaagggctgtgaggacgcctcggttgtggaagctgtctcgtggcttcttccgcaccctaagatctcgaccaactctattatcagaggcagcgctgcagccgacgagatgggttcgtcgcctttccacgaccggccctttagtcccaagcccaagaaacagaaggttgaattgcccgcggacatattctctgatgtggaccctttcctagacttggacgatgcaaccgttaccggaattcaacccgacagcttggtaccagtccatatgccagaatgctccgaggacacggattcgcttgctcactccatggacccttcgtttactaaatttcctctctcggcgaagagcggttacagctatggcacatctacccttactcagagcatttcttgttcgtctctagatgccgccgttgttccagactccagtctcagcgacatttccacaccctacctagactcacaaagctcccaagatatgtcagctcgcctgccacaccagactggaggtcccattgacaccgtcgaccgtgaagctcgcgtgttgcgctacaaggagaagaggcagaagcgcaagtttgagaaaacaattcgctatgcatcaaggaaggcatatgctgagagccggccgaggatcaaaggaaggttcgctaagagaactgattccgacatggagcagtttggctcagtggactcaagtttcggagtggttccaagtttttag

SEQ ID NO: 170 - DNA, 757 bp, Oryza sativa
ctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgag

SEQ ID NO: 171 - DNA, 333 bp, Cauliflower mosaic virus
catcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcga

SEQ ID NO: 172 - DNA, 80 bp, Oryza sativa
ccctccctccgcttccaaagaaacgccccccatcgccactatatacatacccccccctctcctcccatccccccaaccct

SEQ ID NO: 173 - DNA, 61 bp, Triticum aestivum
aaccatcttccacacactcaagccacactattggagaacacacagggacaacacaccataa

SEQ ID NO: 174 - DNA, 480 bp, Oryza sativa
ccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaag

SEQ ID NO: 175 - DNA, 943 bp, Solanum tuberosum
accctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcga

SEQ ID NO: 176 - protein, 228 aa, Zea mays
MARERREIKRIESAAARQVTFSKRRRGLFKKAEELSVLCDADVALIVFSSTGKLSQFASSSMNEIIDKYSTHSKNLGKAEQPSLDLNLEHSKYANLNEQLVEASLRLRQMRGEELEGLSVEELQQLEKNLESGLHRVLQTKDQQFLEQISDLEKKSTQLAEENRQLRNQVSHIPPVGKQSVADTENVIAEDGQSSESVMTALHSGSSQDNDDGSDVSLKLGLPCVAWK

SEQ ID NO: 177 - DNA, 687 bp, Zea mays
atggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaaaaaaagagtacacaactggcagaggagaacaggcaactgaggaatcaagtatcccacatacccccagttggcaagcaatcagttgctgatactgaaaatgttatcgctgaagatgggcaatcctctgaatcagtcatgactgcgttgcattctgggagttcacaggataatgatgatggttcggatgtctctctaaaattagggctgccttgtgttgcatggaagtga

SEQ ID NO: 178 - DNA, 1528 bp, Oryza sativa
ggaagctaactagtcacggcgaatacatgacgacatcggcctacaacgcacaacttcttggcataaaagcttcaatttcaatgcccctatctggaagccctaggcgccgcgcaaatgtaaaacattcgcttcgcttggcttgttatccaaaatagagtatggacctccgacagattggcaacccgtgggtaatcgaaaatggctccatctgcccctttgtcgaaggaatcaggaaacggccctcacctcctggcggagtgtagatatgtgaaagaatctaggcgacacttgcagactggacaacatgtgaacaaataagaccaacgttatggcaacaagcctcgacgctactcaagtggtgggaggccaccgcatgttccaacgaagcgccaaagaaagccttgcagactctaatgctattagtcgcctaggatatttggaatgaaaggaaccgcagagtttttcagcaccaagagcttccggtggctagtctgatagccaaaattaaggaggatgccaaaacatgggtcttggcgggcgcgaaacaccttgataggtggcttaccttttaacatgttcgggccaaaggccttgagacggtaaagttttctatttgcgcttgcgcatgtacaattttattcctctattcaatgaaattggtggctcactggttcattaaaaaaaaaagaatctagcctgttcgggaagaagaggattttattcgtgagagagagagagagagagagagagagagggagagagaaggaggaggaggattttcaggcttcgcattgcccaacctctgcttctgttggcccaagaagaatcccaggcgcccatgggctggcagtttaccacggacctacctagcctaccttagctatctaagcgggccgacctagtagctacgtgcctagtgtagattaaagttggcgggccagcaggaagccacgctgcaatggcatcttcccctgtccttcgcgtacgtgaaaacaaacccaggtaagcttagaatcttcttgcccgttggactgggacacccaccaatcccaccatgccccgatattcctccggtctcggttcatgtgatgtcctctcttgtgtgatcacggagcaagcattcttaaacggcaaaagaaaatcaccaacttgctcacgcagtcacgctgcaccgcgcgaagcgacgcccgataggccaagatcgcgagataaaataacaaccaatgatcataaggaaacaagcccgcgatgtgtcgtgtgcagcaatcttggtcatttgcgggatcgagtgcttcacggctaaccaaatattcggccgatgatttaacacattatcagcgtagatgtacgtacgatttgttaattaatctacgagccttgctagggcaggtgttctgccagccaatccagatcgccctcgtatgcacgctcacatgatggcagggcagggttcacatgagctctaacggtcgattaattaatcccggggctcgactataaatacctccctaatcccatgatcaaaacc

SEQ ID NO: 179 - DNA, 99 bp, Oryza sativa
atctcaagcagcctaatcatctccagctgatcaagagctcttaattagctagctagtgattagctgcgcttgtgatcgatcgatctcgggtacgtagca

SEQ ID NO: 180 - DNA, 804 bp, Zea mays
accgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcgg

SEQ ID NO: 181 - DNA, 250 bp, Oryza sativa
ggattgggaagcaagcttgggaattggtttgagatttgaggaggaaaagcataatggcagcttatttgggtaattaattggtgtgggtttaattttcctttttccgtatggattgtaaattagtcgtcggaggccatggccaccgaacgatcgaatttagtgttttcatcggggtttaatcaatcgcgaacaattgtaatcaaatacacttgtttaaatctcatcaatgttttcatgaaaatcatctcga

SEQ ID NO: 182 - protein, 337 aa, Brassica juncea
MLKQESNWAQTCDTCRSAACTVYCRPDSAYLCTSCDAQIHEANRLASRHERVRVCQSCERAPAAFFCKADAASLCTACDSQIHSANPLARRHQRVPILPISGSMVTNHSSETTEAEDIVVVGQEEEDEAEAASWLLPTSVKNCGDNNNNNNNSQDNRFSVGEEYLDLVDYSKYQQDYNVPQRRSYVADGVVPLQVEVSKSLSHMHHEQHNFQFGFTNVSSEASPIHMVSLVPESSLSETTVSNPRSPKAATEELPEAPVQMLSPMERKARVMRYREKKKTRKFEKTIRYASRKEYAEKRPRIKGRFAKRNEVDAEEADKAFSSMVMFDTGYGIEPSF

SEQ ID NO: 183 - protein, 345 aa, Oryza sativa Japonica Group
MASAAAATGAALGARTARACDGCMRRRARWHCPADDAFLCQACDASVHSANPLARRHHRVRLPSASSSPASSPRSAAAPRAGSDDPDAPAWLHGLKRRPRTPRTKPGGGGKHDASAATVAAAAASAVPDLEAEESGIVGDTDHDVGEEDDEDLLYRVPGFDDLGFLDDEKPHVKLDLDMDMDFASISPAPAPEREERKRKRPEMILKLDYEGVIDSWARDGASPWFHGERPRFDPSESWPDFPAGSRGGLGAAVTAVTGGEREARVSRYREKRRTRLFAKKIRYEVRKLNAEKRPRMKGRFVKRAAALPPLPLPRHQHPPPPPPRALPPVPMMLAPRGAHGRYRF

SEQ ID NO: 184 - protein, 410 aa, Picea abies
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 185 - protein, 410 aa, Picea abies
  misc_feature (152)..(152): Xaa can be any naturally occurring amino acid
  misc_feature (155)..(155): Xaa can be any naturally occurring amino acid
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNXLLXHQEEDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 186 - protein, 410 aa, Picea abies
  misc_feature (245)..(245): Xaa can be any naturally occurring amino acid
  misc_feature (389)..(389): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHXGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVXVEQIYSSSLLPDQGYGVVPSY

SEQ ID NO: 187 - protein, 410 aa, Picea abies
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 188 - protein, 410 aa, Picea abies
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEEDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 189 - protein, 410 aa, Picea abies
  misc_feature (151)..(152): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHXXLLNHQEEDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 190 - protein, 410 aa, Picea abies
  misc_feature (293)..(293): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNXCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 191 - protein, 410 aa, Picea abies
  misc_feature (161)..(161): Xaa can be any naturally occurring amino acid
  misc_feature (177)..(177): Xaa can be any naturally occurring amino acid
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEEDXDAEICCAEEAATASWXIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 192 - protein, 410 aa, Picea abies
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEEDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 193 - protein, 410 aa, Picea abies
  misc_feature (120)..(120): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVXLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 194 - protein, 410 aa, Picea abies
  misc_feature (118)..(118): Xaa can be any naturally occurring amino acid
  misc_feature (159)..(159): Xaa can be any naturally occurring amino acid
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCXVLLNEDGGGDDPLKHDYVDDDYDDYDDDENDHNNLLNHQEXDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 195 - protein, 410 aa, Picea abies
  misc_feature (179)..(179): Xaa can be any naturally occurring amino acid
  misc_feature (193)..(193): Xaa can be any naturally occurring amino acid
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIXEANRNNLTNINGGXSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 196 - protein, 410 aa, Picea abies
  misc_feature (182)..(183): Xaa can be any naturally occurring amino acid
  misc_feature (208)..(208): Xaa can be any naturally occurring amino acid
  misc_feature (226)..(226): Xaa can be any naturally occurring amino acid
  misc_feature (233)..(233): Xaa can be any naturally occurring amino acid
  misc_feature (235)..(235): Xaa can be any naturally occurring amino acid
  misc_feature (243)..(243): Xaa can be any naturally occurring amino acid
  misc_feature (248)..(248): Xaa can be any naturally occurring amino acid
  misc_feature (282)..(282): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEAXXNNLTNINGGNSEGEDKMVKDKLKFXAYMQSIDFLQDVENYVDXEYLGTTXTXTTPTTPTXHMGAXSMVPVHTPEVIEHSSTKVSVETARSLDVDAASKXNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 197 - protein, 417 aa, Ipomoea nil
MLKEESCEVLDLDVTIGSSSGSRSGNKQNWARVCDICRSAACSVYCRADLAYLCGGCDARVHGANTVAGRHERVLVCEACESAPATVICKADAASLCAACDSDIHSANPLARRHHRVPILPISGTLYGPPTSNPCRESSMMVGLTGDAAEEDNGFLTQDAEETTMDEDEDEAASWLLLNPNPNPNPNPVKSNNSTNMCKGGNNNNNEMSCAVEAVDAYLDLAEFSSCHNNLFEDKYSINQQQNYSVPQRNMSYRGDSIVPNHGKNQFHYTQGLQQHNHHAIFNCKEWNMRILTRDMVSISSMDVGVVPESTLSDTSISHSRASKGTIDLFSGPPIQMPPQLQLSQMDREARVLRYREKKKTRKFEKTIRYASRKAYAETRPRIKGRFAKRTDVDTEVDQIFYAPLMAESGYGIVPSF

SEQ ID NO: 198 - protein, 380 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRFAKMSETEVEDQEYNTMLMYYDTGYGIVPSFYGQNKEY

SEQ ID NO: 199 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNNNISENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 200 - protein, 360 aa, Solanum tuberosum
MGTENWSLTAKLCDSCKTTPATVFCRADSAFLCLGCDCKIHAANKLASRHARVWVCEVCEQAPAVVTCKADAAALCVTCDRDIHSANPLARRHERFPVVPFYDSAVAKSDGGGDADADAADDEKYFDSTSENPSQPEEEAEAASWILPIPKEGTDQYKSADYLFNDMDSYLDIDLMSCEQKPHIIHHQQHQHGHYSSDGVVPVQNNNNETSTHLPGPVVDGFPTYEIDFTGSKPYMYNFTSQSISQSVSSSSLDVGVVPDHSAMTDVSNTFVMNSSAAAGTGTDTEAVPNAVSGLDAGARVMRYRKKRKNIKIEKTIPYASTKAYAETRPKIKGRFAKRTEIEIDLLIDADASYGVVPSF

SEQ ID NO: 201 - protein, 407 aa, Oryza sativa Japonica Group
MDALCDFCREQRSMVYCRSDAASLCLSCDRNVHSANALSRRHTRTLLCDRCVGQPAAVRCLEENTSLCQNCDWNGHGAASSAAGHKRQTINCYSGCPSSAELSRIWSFSMDIPTVAAEPNCEEGINMMSINDNDVNNHCGAPEDGRLLDIASTALMSDLPTGDKFKPLIGSSSGDGMNLLPLNSDQPAEPVSTTPKAPCVTDKDMFNDGSVYGDFCVDDADLTFENYEELFGTSHVQTEQLFDDAGIDSYFEMKDVPADESNEQPKPVQPECSNVASVDSGMSNPAARADSSHCIPGRQAISNISLSFSGLTGESSAGYFQDCGVSSMILMGEPPWHPPGPESSSAGGSRDNALTRYKEKKKRRKFDKKIRYASRKARADVRKRVKGRFVKAGEAYDYDPLSQTRSY

SEQ ID NO: 202 - protein, 407 aa, Oryza sativa Japonica Group
MGALCDFCGEQRSMVYCRSDAASLCLSCDRNVHSANALSRRHTRTLLCDRCASQPAMVRCLVENASLCQNCDWNGHSAGSSAAGHKRQTINCYSGCPSSSELSKIWTFVSDIPNVAPEPNCEQGISMMSISDSGVSNQDNAAGDSSLLDIASATLMSDLGTAGKPKSLIGSSSEAGVNLLPLATDQMAGSVDSTSAKVPYTADQDMFSKDSIYEDFCVDDVDLSFENYEELFGTSHIQTEQLFDDAGIDSYFESKEIPSGNSDEPKLMQPVTSNAVSADSGMSIPGAKGDSSLCIPVRQARSSISLSFSGLTGESSAGDYQDCGVSPVLLMGEPPWHPPGPEGSFAGATRDDAITRYKEKKKRRKFDKKIRYASRKARADVRKRVKGRFVKAGEAYDYDPLCETRSY

SEQ ID NO: 203 - protein, 335 aa, Oryza sativa Japonica Group
MLKLEPEFPGLPQRCDSCRSAPCAFYCLADSAALCATCDADVHSVNPLARRHRRVPMGVVAAPGAGGAFVVRPAGGVNSSWPIREGRRCDYDDDDADAAGEEDEEATSWLLFDPLKDSSDQGLPPFGDALVADFLNLGGGAGEKEDASSSKDCSSSHGKSSEGSHEFAVPGEPVPERQGFGAVSMDITDYDASNFRRGYSFGASLGHSVSMSSLENMSTVPDCGVPDITTSYLRSSKSTIDLFTAAAGSPVAAHSIMSPPQFMGAIDREARVHRYREKRKTRRFEKTIRYASRKAYAETRPRIKGRFAKRSDTDLEVDQYFSTTADSSCGVVPTF

SEQ ID NO: 204 - protein, 335 aa, Brassica oleracea var. alboglabra
MLKQESNWAQTCDTCRSAACTVYCRADSAYLCTNCDAQVHAANRLASRHERVRVCQSCERAPAAFFCKADAASLCTACDSQIHSANPLARRHQRVPILPISGSMVTNHSSETTETEDIVVVGQEEEDEAEAASWLLPSSLKNSGDNNNNNNNNNSENRFSVGDEYVDLVDYNKYQQDYNVPQRSYVADGVVPLQVGVLKSHMHHEEHNFQFGFTNVSSEASPIHMVSLVPESTLSETTVSHPRSPKVATEELHDAPVQMLSPVERKARVMRYREKKKKRKFEKRIRYASRKEYAEKRPRIKGRFAKRNEVDAEEADKAFSSMVMFDTGYGIVPSF

SEQ ID NO: 205 - protein, 366 aa, Brassica oleracea var. alboglabra
MFKQESNNICNRENNRGAPACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNNQNNELLFSDDYLDLADYNSSMDYKFTSQYNQPRHKQDCIVPEKNYSGDRVVPLQLEETRGNLRNKQQNITYGSSGSQYNNNGSINHNAYNPSMETDFVPEQTAPDTTVSHPKTHKGKTAQLPEPLIQILSPMDREARVLRYREKKKRRKFEKTIRYASRKAYAERRPRINGRFAKMSETEVEDQEYNTMLMYCDTGYGIVPSFYGQK

SEQ ID NO: 206 - protein, 413 aa, Solanum tuberosum
MLKKEKSGGFDRSSNNWARVCDSCHSATCTVYCRADSAYLCAGCDSRIHAASLMASRHERVWVCEACERAPAAFLCKADAASLCASCDAVIHSANPLARRHHRVPIMPIPGTLYGPPAVHTVSGGSMMIGGTTGEGTEDDGFLSLTQDADDTTIDEEDENEAASWLLLNPPVKNNNKNNINNNNNNQNNNYGMLFGGEVVDEYLDLAEYGGDSQFNDQYSVNQQQQHYSVPQKSYVEDSVVPVQNGQRKSLILYHQPQQQQQQQQQSHHLNFQLGMEYDNSNTGYGYPASLSHSVSISSMDVSVVPESALSETSNSHPRPPKGTIDLFSGPPIQIPPQLTPMDREARVLRYREKKKNRKFEKTIRYASRKAYAETRPRIKGRFAKRTDVKAEVDQMFSTQLMTDSSYGIVPSF

SEQ ID NO: 207 - protein, 444 aa, Populus trichocarpa
MICIKSSANAVGGKTARACDSCIKKRARWYCAADDAFLCQACDSSVHSANPLARRHERVRLKTASLKSLDLCSKENSVPSWHGGFTRKARTPRHGKPVSQSKIAETIRNIPIPLVPEVGSDEISHEDNEEEHLLYRVPIFDPFVADLCASTTISNEAGAIVPAGGNDGTDQRVADSNGVESKILIGAIERRDVESLPGFLPSDMDLAEFAADMESLLGRGLENESFGMEELGLMDCKEEKEFEVKGFPLWNGKVKVEDEENASVERKAVRKCYAGIETDMAKDPIFELSFDYNSSATCGEEDEKVGIEEGDLKNTRGEYEDDDGAKRKILLSLDYEAVMTAWASQGSPWTNGNRPDFDPDECWPDCMGICGAQLHHPYGDMISGLGAHPAMVDGGREARVSRYREKRRTRLFSKKIRYEVRKLNAEKRPRMKGRFVKRTTLAGK

SEQ ID NO: 208 - protein, 416 aa, Arabidopsis thaliana
MKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 209 - protein, 405 aa, Arabidopsis thaliana
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 210 - protein, 347 aa, Oryza sativa Indica Group
MELGLGRYWGVGGRRCGACAVAPAAVHCRTCDGGGGGGGYLCAGCDAEHGRAGHERVWVCEVCELAPAAVTCKADAAALCAACDSDIHDANPLARRHERVPGHPIGSSAAPPPDALLLGGENDAAAAVDGGGGGKEVKLDFLFADFMDPYLGGSPELARFPHADSVVPNHNGSAGPAMELGFAGGGGAAVKPSYSSYTAASLGNSGSSSEVGLVPDAICGGGGGGIIELDFAQSKAAYLPYASTPSHSMSSSMDMGVAAPEMSDGAAAAAGRAYAAEGRAARLMRYREKRKNRRFEKTIRYASRKAYAETRPRVKGRFAKRADDHDAAAPPPQIMLDFAGYGVVPTF

SEQ ID NO: 211 - protein, 447 aa, Oryza sativa Indica Group
MSSKAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAVGQLLSRRLVVVPEEAAGSGGDSPEERKDEGEIVEEQEQLLYRVPIFDPALSEFCSPPPLEDAAAAVSCCNEDGAVENPTKPSMTTTTATTPPLQFFPDGHANFGPTDAELREFAADMEALLGRGLDDGNDEDSFCMETLGLIEPVDDDAGRVKVEADGDAGMTLAWCHELDTETSSGEMLDIDFDYGSPQAATTPDEKVGSSGPAAAADDDAQFQQSSLALSLNYEAIIESWGTSPWTDGERPRVKLDDSWPRDYSGVWMAAAGVFGHGGEEQALTPRLGMDGGREARVSRYREKRRTRLFSKKIRYEVRKLNAEKRPRMKGRFVKRAAAAAAVATACVA

SEQ ID NO: 212 - protein, 448 aa, Oryza sativa Japonica Group
MSSTAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAFGQLLSRRLVVVPEAAAGSGGDSPEERKDEGEIVEEQEQLLYRVPIFDPALSEFCSPPPLEDAAAAVSCCNEDGAVENPTKPSMTTTTATTPPLQFFPDGQANFGPTDAELREFAADMEALLGRGLDDGNDEDSFCMETLGLIEPVDDDAGRVKVEADGDAGMTLAWCHELDTETSSGEMLDIDFDCGSPQAATTPDEKVGSSGPAAADDDAQLQQSNLALSLNYEAIIESWGTSPWTDGERPHVKLDDSWPRDYSGVWMAAAGVFGHGGEEQALTPRLGMDGGREARVSRYREKRRTRLFSKKIRYEVRKLNAEKRPRMKGRFVKRAAAAATAAVATACVA

SEQ ID NO: 213 - protein, 438 aa, Vitis vinifera
METTSKSRPSAAVPCDFCDSKTAVVHCRADSAKLCLLCDRHVHSANALSRKHLRSQICDNCRTEPVSFRCFTDNLALCQSCDWDSHGNCSVPSLHERTPVESFSGCPSPLELASVFRVDLKDGNWSSWNFGSVNVQDFVVPGENCYAGCGTKVEKNGISVVYEQLVDLIRSDVDVVRGDVDGDGDEGEDGAELGPGTPGRCANMGNFQGVDLDNGDDEELLRQQTPFTSLLMLPTPVDARDTGCGYGCAVEGDAMWDRGHLSYQAPQIWDFHLGRSRICKETSPEAGYDVDNSGFVIKNYSEITKGSSLTRTKALQGMYEMNCTTTHEDILSKNSHSNKALSSQGPTTAESNNIPIVGPSSESWTAEPNTNSIKSMQFKDLLIGSGTARTETTNVDMELLAQNRGHAIYEKHIRYESRKARADTRKRVKGRFVKASDS

SEQ ID NO: 214 - protein, 449 aa, Vitis vinifera
  misc_feature (108)..(108): Xaa can be any naturally occurring amino acid
  misc_feature (225)..(225): Xaa can be any naturally occurring amino acid
  misc_feature (275)..(275): Xaa can be any naturally occurring amino acid
  misc_feature (288)..(288): Xaa can be any naturally occurring amino acid
MLKDEGCNADAAAGGGGGWARVCDTCRSAACTIYCRADSAYLCAGCDARIHAANRVASQHERVWVCESCERAPAAFVCKADAASLCATCDADIHSANPLARRHHRVPXLPIAGCLYGPPATDPGGTVVRSAAEADNGFLGQEAEETIDEEDEDEAASWLLLNPVKNNNGSSNNQNNGLLFGGEVDEYLDLVEYNSCPENQFSDQYNQQQPPPHYSVPHKNYGGDXVVPVQCGEAKGQLHQQHQQQGFHLGMEYESSKAAYSYNPSISHSVSFFIXVNCLISLILHDHXAYAFQTHTGLSESSVSSFILVYGGCLQFIQIHPKFIRSHVSVSSMDVGVVPEATTMSDISISISHPRPPKGTIDLFSGPPIQMPTQLTPMDREARVLRYREKKKTRKFEKTIRYASRKAYAETRPRIKGRFAKRTDVEVEVDQMFSTTLMAESGYGIVPSF

SEQ ID NO: 215 - protein, 475 aa, Vitis vinifera
  misc_feature (37)..(37): Xaa can be any naturally occurring amino acid
  misc_feature (51)..(51): Xaa can be any naturally occurring amino acid
MHDGNEFKLKEEHLDASSTANALTGGEWLRGVEGETXMKATIEHANKVYKXVRGIIGNVETKQQMDLTQAKVANAMGGKTARACDNCLHKRARWYCGADDAFLCQACDASVHSANQLAERHERVRLQAASCKNADSMRDNSTPAWHQGFTRKARSPRNVKRTSVQPSKHENKFPTPPPLVPEIGSEEASPDENEEQFLFRVPTFDPFVAELNNDGIREIGMENDSKPLSDYGHEEIGDLDSLTGFLPSEMDLAEFAADVESYLGAGLDEDSCGIKGIGVLDCEQGDMDACFGDQKVKVKEERVETDATFHLDPELDMTKELLAWNLDYESTVMDEEEHEEKMVAAVEMRRKISLSLNYEDVITAWASQGSPWTTGNRPEFDPNDYWPDYMGACPTNVHGPCGDVGGVGGNFGGRDGGREARVLRYREKRRTRLFSKKIRYEVRKLNAEKRPRMKGRFVKRASFAAGPCFPILNVK

SEQ ID NO: 216 - protein, 392 aa, Arabidopsis thaliana
MVVDVESRTASVTGEKMAARGCDACMKRSRASWYCPADDAFLCQSCDASIHSANHLAKRHERVRLQSSSPTETADKTTSVWYEGFRRKARTPRSKSCAFEKLLQIESNDPLVPELGGDEDDGFFSFSSVEETEESLNCCVPVFDPFSDMLIDDINGFCLVPDEVNNTTTNGELGEVEKAIMDDEGFMGFVPLDMDLEDLTMDVESLLEEEQLCLGFKEPNDVGVIKEENKVGFEINCKDLKRVKDEDEEEEEAKCENGGSKDSDREASNDKDRKTSLFLRLDYGAVISAWDNHGSPWKTGIKPECMLGGNTCLPHVVGGYEKLMSSDGSVTRQQGRDGGGSDGEREARVLRYKEKRRTRLFSKKIRYEVRKLNAEQRPRIKGRFVKRTSLLT

SEQ ID NO: 217 - protein, 332 aa, Arabidopsis thaliana
MEAEEGHQRDRLCDYCDSSVALVYCKADSAKLCLACDKQVHVANQLFAKHFRSLLCDSCNESPSSLFCETERSVLCQNCDWQHHTASSSLHSRRPFEGFTGCPSVPELLAIVGLDDLTLDSGLLWESPEIVSLNDLIVSGGSGTHNFRATDVPPLPKNRHATCGKYKDEMIRQLRGLSRSEPGCLKFETPDAEIDAGFQFLAPDLFSTCELESGLKWFDQQDHEDFPYCSLLKNLSESDEKPENVDRESSVMVPVSGCLNRCEEETVMVPVITSTRSMTHEINSLERNSALSRYKEKKKSRRYEKHIRYESRKVRAESRTRIRGRFAKAADP

SEQ ID NO: 218 - protein, 372 aa, Arabidopsis thaliana
MGYMCDFCGEQRSMVYCRSDAACLCLSCDRSVHSANALSKRHSRTLVCERCNAQPATVRCVEERVSLCQNCDWSGHNNSNNNNSSSSSTSPQQHKRQTISCYSGCPSSSELASIWSFCLDLAGQSICEQELGMMNIDDDGPTDKKTCNEDKKDVLVGSSSIPETSSVPQGKSSSAKDVGMCEDDFYGNLGMDEVDMALENYEELFGTAFNPSEELFGHGGIDSLFHKHQTAPEGGNSVQPAGSNDSFMSSKTEPIICFASKPAHSNISFSGVTGESSAGDFQECGASSSIQLSGEPPWYPPTLQDNNACSHSVTRNNAVMRYKEKKKARKFDKRVRYASRKARADVRRRVKGRFVKAGEAYDYDPLTPTRSY

SEQ ID NO: 219 - protein, 347 aa, Arabidopsis thaliana
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAPSETDADNDEDDREVASWLLPNPGKNIGNQNNGFLFGVEYLDLVDYSSSMDNQFEDNQYTHYQRSFGGDGVVPLQVEESTSHLQQSQQNFQLGINYGFSSGAHYNNNSLKDLNHSASVSSMDISVVPESTASDITVQHPRTTKETIDQLSGPPTQVVQQLTPMEREARVLRYREKKKTRKFDKTIRYASRKAYAEIRPRIKGRFAKRIETEAEAEEIFSTSLMSETGYGIVPSF

SEQ ID NO: 220 - protein, 373 aa, Arabidopsis thaliana
MGYMCDFCGEQRSMVYCRSDAACLCLSCDRNVHSANALSKRHSRTLVCERCNAQPASVRCSDERVSLCQNCDWSGHDGKNSTTTSHHKRQTINCYSGCPSSAELSSIWSFCMDLNISSAEESACEQGMGLMTIDEDGTGEKSGVQKINVEQPETSSAAQGMDHSSVPENSSMAKELGVCEDDFNGNLISDEVDLALENYEELFGSAFNSSRYLFEHGGIGSLFEKDEAHEGSMQQPALSNNASADSFMTCRTEPIICYSSKPAHSNISFSGITGESNAGDFQDCGASSMKQLSREPQPWCHPTAQDIIASSHATTRNNAVMRYKEKKKARKFDKRVRYVSRKERADVRRRVKGRFVKSGEAYDYDPMSPTRSY

SEQ ID NO: 221 - protein, 373 aa, Arabidopsis thaliana
MLKQESNDIGSGENNRARPCDTCRSNACTVYCHADSAYLCMSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 222 - protein, 355 aa, Arabidopsis thaliana
MLKVESNWAQACDTCRSAACTVYCRADSAYLCSSCDAQVHAANRLASRHERVRVCQSCERAPAAFFCKADAASLCTTCDSEIHSANPLARRHQRVPILPISEYSYSSTATNHSCETTVTDPENRLVLGQEEEDEDEAEAASWLLPNSGKNSGNNNGFSIGDEFLNLVDYSSSDKQFTDQSNQYQLDCNVPQRSYGEDGVVPLQIEVSKGMYQEQQNFQLSINCGSWGALRSSNGSLSHMVNVSSMDLGVVPESTTSDATVSNPRSPKAVTDQPPYPPAQMLSPRDREARVLRYREKKKMRKFEKTIRYASRKAYAEKRPRIKGRFAKKKDVDEEANQAFSTMITFDTGYGIVPSF

SEQ ID NO: 223 - protein, 397 aa, Zea mays
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEATATAASVAGDKDEEVDSWLLLTKDPDDDDKNHNCSSNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISYSSSMEVGIVPDNMATTDMPSSGILLTPAGAISLFSSGPPLQMPLHLASMDREARVLRYREKKKSRKFEKTIRYATRKTYAEARPRIKGRFAKRSSDMDDEVDQMFSAAALSSDGSYGTVPWF

SEQ ID NO: 224 - protein, 398 aa, Zea mays
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 225 - protein, 410 aa, Chlamydomonas reinhardtii
MSSCVVCAAAAVVWCQNDKALLCKDCDVRIHTSNAVAARHTRFVPCQGCNKAGAALYCKCDAAHMCEACHSSNPLAATHETEPVAPLPSVEQGAAPEPQVLNMPCESVAQSAASPAAWFVDDEKMGTTSFFDAPAVLSPSGSEAVVPVMSAPIEDEFAFAAAPATFKEIKDKLEFEALDLDNNWLDMGFDFTDILSDGPSDVGLVPTFDAVDEAADAVADAIVPTFEEEQPQLQQQEPLVLAPAPEESAASRKRAAAEEAAEEPAAKVPALTHQALLQAQAAAFQAVPQASALFFQPQMLAALPHLPLLQQPMMPAAVAPAPVPKSGSAAASAALAAGANLTREQRVARYREKRKNRSFAKTIRYASRKAYAEIRPRIKGRFAKKEEIEAWKAAHGGDDAIVPEVLDAEC

SEQ ID NO: 226 - protein, 538 aa, Physcomitrella patens subsp. patens
MATKVASRSMTTAIAIAGRASRACDVCANKSARWYCGADTAYLCDRCDTQVHSANALAKRHERVRLTVSGVPMKSSRKVTVTMADHDEDSEMPRKQSSLKKCHSAPVQVMSSRKRSRTSRPHPLKRRASEAKPTSKVSKVEDVKVKEELLTFSDIFDTEDFLVDDTQEVPAFITVAQDSSPSSSEFDLSSPELSPEFRSDFYGVCSPSEDSFAAYFKGKAAHNDFSDDVMADQFVVPDGVFDNCLDSGVNICCDVDSSISIAGDACFIPGDIPGLDGYEDDYSLCFHLALRDASPDSFGEDSAATATATGRSLEDSPSRVLLCTCFYYFTPSILNNVLKCRKQMYRPECANADAIPVISYLAVVHPTNNAVSVEADQFGNGPFAKFFAKKPKGEKVLLSPENIKSEAKEILRCSLEGLSEEDLRTAPTLRLNYEDVLTAWSDRGEPWVNPENSTVVPDMGEGGADDDQTGGGREARVLRYKEKRRSRLFSKTIRYEVRKLNAERRPRMKTCGGSDGGGGLRQAATVAAAKSLSILKLS

SEQ ID NO: 227 - protein, 574 aa, Physcomitrella patens subsp. patens
MARPKSTAHTNMATAMAIAGRASRACDGCGSQGARWYCEADNAYLCSRCDRSVHSANALASRHERVRLNPHGTVSQVPKKALVDTSGADGNDAHKPHHPRSTHTHFLPSRKRSRLCQRPNPHLQHAADISNPEHRRGKMKTESRNPGESHEVPNFITINIQESPLSFAHDSATGISMAEFCKGRATATAAMYVGVEDAYEELSSGDSGPDFLVPNGYTEDFDSAIGAPTEYHQNAGSPLDSGNGDEDSDNSHEMACVGDGLQLCGSDERYEGYPLEFSDIVGLGNGDAFEEDCENTSGFVDECCEVNGGGLGNGMECSLQAKMSLEQQKGFSFSKDFYYEVNQECIVPDSYDLIRKEVADVLRCSLEGEPMKHTPSLLQLNYEDVLSAWSDRCLWTDGKCPQKLPDDSYSEIAGDVGLVPDLSNGCQAVPGGGGDGGREARVMRYKEKRRTRLFSKKIRYEVRKLNAECRPRMKKPNCAYSLQHPNAAMSQSFRNENNVFLWYLVETGPIREEDTWVLVIRTKAHTSQHGSITVTTYSVWLGGRKSSSGTCDGSADESWFLRGDHANPHLVDIF

SEQ ID NO: 228 - protein, 495 aa, Physcomitrella patens subsp. patens
MTTRTACKSIVTAMAIAGQASRACDVCMNKSARWYCGADRAYLCEKCDIQVHSANALAQRHERVPLTPNAESTILARKDSPDTKNAKEILLRKPTMSKKLQAPPVNVLPSRKRFRTCRLHPFRQAKHSPGAKHAPNQLEEGDAKMKEDLLMFSETFETENFLVDVTQKVPSLIVVMQDSSPSSSELDVCSDFFQELRSDSQEVRSSPWSDSLAAFFKGKAAQEDCFPDDDTSDQFFLPDAFDDGINICCDMDGNISVAGDACFISNDIPGLSGFEDFGSREFVGDSLSFDFAFHDTLPRAFEGVGADTSEMGGISSKYNLVGAENDQFRTGPFVKFFSKIPRNEKKMHLTPENIKKEAKEILLCCREGLSEVNLGLAPTLRLNYEDVITAWSDRGEPWFYPHDCTSDATDAGLVPDMAQEGADDCQGSREASVMRFKEKRRSRLFSKRIRYEVRKLNAEKRPRMKGRFVKKNSSGFDFRLDPFLSSETHVLAHPH

SEQ ID NO: 229 - protein, 364 aa, Physcomitrella patens subsp. patens
MPKSCDACHISSAVVYCRADAAYLCAGCDGKVHGANKLASRHERVWMCEVCEVAVAVVTCKADAASLCVSCDTDIHSANPLAQRHERVPVQPLFDCASSAREAHISVPFPESECHETLKGVEDSCVAEAGSWLLPHPKIPTNAIIRGSAAADEAPDSPFRARPFSPKLKKQKVDLAADIFSDVDPFLELDDATVTGIQPDSLVPVHIPEGSEDSPSLAHSMEPSFTTDFHLSEKSGYSFGTSTLTHSISCSSVDAAVVPDSSLSDISTPYPLDSQGAQELSGTRMPQQVSGPIDTVDREARVMRYKEKRQKRKFEKTIRYASRKAYAESRPRIKGRFAKRTDSDVEQLFSSCSMDSSFGVVPSF

SEQ ID NO: 230 - protein, 495 aa, Physcomitrella patens subsp. patens
MPGGGVKDAATNSVATAMAIAGRASRACDVCGSQRARWYCNADNAYLCYRCDQNVHSANALALRHERVRLNSQGNISSQSPRKALVVDTSARKHSRNHTAHAAQSPPSRKRSRLSRRPNPHVSSPVDTLFKPHKASHRGSKVKSESSHEVPNFVTVNIQESSFSFTHDSATVMSMAEYCKGRAAAAAAAAMSMSVDVDTYEELSSGDSDQFLVPTGYLDDFESAAVAPVEDGSSPSEDAEDAPGYEENHHDITDAVDLRDGLELEGGSDDAYRLDFSDIVALREGDEDAFEGDYGETEGDAFEGECGDTEGDGEVEAAASNEQSCVDGFPEEQPNCVVPFTKEYLYKVKSENSVRDGFALIKKEVAAVLRCSLEGEEAKPAAPSLLRLNFDDVLSAWSDRSLWTDGKRPQTVPDDSSEAVGGLDLGLVPDLSKGCAQGQPGTGGDRGREARVLRYREKRRTRLFSKKIRYEVRKLNAERRPRMKGRFVKRTTGCS

SEQ ID NO: 231 - protein, 646 aa, Physcomitrella patens subsp. patens
MAGVKGAAHANVAMAMAIAGRASRACDVCGSQRARWYCEADNAHLCNRCDQSVHSANALALRHERVRLNPQDCTTQPLKKVVVDTLDASNKSRKSHHPRPTDKHSLPSRKRSRLSRRPNPHLRPPTSTSKSQHRRGKVKSEGRGAEDSHEVPNFITVNIQESPVSFAHDSATAMSMAEFCKERATAAASVYVDVEDAYEEISSGDTGPDFLVPNGYMDDFESAIGAPIGCHEDARSPFDSGNGAMDMNKSHDIMFMRNDLELCGSDEQYEDYPLDFSDIVGLRDGDAFEGDCGDTSELVDEVGEENKDEDGDGDGDGDGDGFECSLDARAQSNVCEDQGLVSYTQDFPYKVKQEYTVPDSYDLIKKEVAAVLRCSLQGEEVKPAPSLLRLNYEDIMSAWSDRSLWTDGKRPQTVPDDSNSESTVDLGMVPDFGNGCQTVPGGSDGGRGARIMRYREKRRTRLFSKKIRYEVRKLNAERRPRMKSQLRYDLALSWVWHYRMTVLTDRNKESMMSKASWKYVPVRSLVRMCDRLVPRELSILWPLILQPGIHHLDRLEQQYQKSGSTGGLDWLRMALRLEHLNSVMGCLSFQSLLPLSVVQTRFQRVTTKRSDSVGEELFNDTPSSVIYSLTEGLIVMRTGILCNCTL

SEQ ID NO: 232 - protein, 475 aa, Physcomitrella patens subsp. patens
MAGGGGIKGAVNNNVATAMAIAGRDSRACDVCGLHRARWYCSVDNAHLCRRCDQNVHSANALALHHERVRLDLQGNALHTPRKALKGNTSAPQNSLKSAAQMDHAAPSRKSFRQSRRPNTDASPPNSHKINRRGKEKSDSSHEVPNFVTVNIHESPFSFTHDSATAMSIAEYCKGRAAAAAAMAADVDTNEELSSGDSDQYLVPNGYLDDFESATVPTPGCRQQGCDPSDDAASNDALDDGEGKDQYDSGAFDQTNGLEFKRGSDQDRINEKYRLGFSEVVGMRDADDFEGESGYTEGEGEVEDEAYDQSCAYGDPERQRVSPFVKDLKSEYDVLDRLDLIKREVAAVLRCSLEAQEKKSAPPPLLRLNFDDVLSAWSDRSLWTDGRRPQTVPDDSSEAVGGTDVGLVPDINTQYAQGATLAAGDKGREFRVMRYKEKRRTRLFSKKIRYEVRKLNAERRPRMKGRFVKQTPGGS

SEQ ID NO: 233 - protein, 368 aa, Physcomitrella patens subsp. patens
MPKSCDACQASSAVVYCRADAAYLCLGCDGKVHGANKLASRHERLWMCEVCEVAAAVVTCKADAASLCVSCDTDIHSANPLAQRHERVPVQPLFDCVSQFRGTHFSVLAPKNECNNNLLKGDEDPAVAEAVSWLLPHPKTLSSAILRGIAAADEAPAFPFRERPFSPKLKKLKVEQAADIYSDVDPFLVLDGGNGTGFQPDSMVPVHIPEGPDDSPSLANSTAPSSAINFRASQKSGCSYGTSTLTHSMSCSSVDAAVVPDSSLSDISTPYSKALDSQDSQDLSGALVPHQASKPIDTVDREARVMRYKEKRQKRKFEKTIRYASRKAYAESRPRIKGRFTKRTDSDVEQMFSSCTADSGFGVVPSSC

SEQ ID NO: 234 - protein, 313 aa, Arabidopsis thaliana
MISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 235 - protein, 406 aa, Arabidopsis thaliana
MMKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 236 - protein, 367 aa, Beta vulgaris subsp. vulgaris
MMKEEVSGSDTNSWARVCDTCRAAPCTVYCRADSAFLCTSCDARIHAANQVASRHERVWVCEACERAPAAFLCKADAASLCATCDAEIHSANPLARRHQRVPIMPVAGCVYGPQGGRMSEDRFLTLPEGDDHTTDHEGDEDEAASWLLLNPVKNSNNQNTNGFLTGGGEVDEYLDLLEYNSGADNQLCEQYNQQQEFKVPEKNCGGDSVVPVQCREAKDHQIQYQNFLFGMECETKSGYTYNTSISQSVSVSSMDVGVVPESAMSDISMSHPRPPKGTIDLFSSPPMQVPTQLSPLDREARVMRYREKKKNRKFEKTIRYASRKAYAETRPRIKGRFAKRTDVEAEMDQMFTNSLMADSGYGIVPSY

SEQ ID NO: 237 - protein, 386 aa, Solanum lycopersicum
MGIFREAPNCFPGGWNIGAAARMAKSCEYCHLAAALVFCRTDNTFVCLSCDTRLHARHERVWVCEVCEQAAASVTCRADAAALCVACDRDIHSANPLARRHERVPVVPFYDPVESVVKSTAATLLVSINGTTTTATTTATITPELGKVDTCIGHHENNNDPWIPPNTITSKLPLNTEMKGMDFIFTDSENFLDFDYPACVDTQSQPHYNSSNDSVVPVQANTPIKSLPFHHQEKHFEIDFTQSHIKSYNTPSLSVSSSSLDVGIVPDGSSISEISYPYIRTMNNSNSSIDLSNSANHQGEKLLGLDREARVLRYREKKKNRKFEKTIRYASRKAYAETRPRIKGRFAKRTDGSAGAGEFDDVDGIFSGTDFIAAESRYGVVPSFLT

SEQ ID NO: 238 - protein, 395 aa, Zea mays
MDYNFDTSVLDEDVAGRGGREGSCPPAWARACDGCRAAPSVVYCHADTAYLCASCNSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 239 - protein, 444 aa, Picea abies
MVKEEDKDWHTVEDLHRGSHVDHKEFLRGIGGWRMSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 240 - protein, 339 aa, Brassica nigra
MLKQESNYNISNRENNRGPRACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSHNHNNNNQNNELLFSDDYLDLADYNSSMDYKFAGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 241 - protein, 339 aa, Brassica nigra
MLKQESNYNISNRENNRGPRACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSHNHNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 242 - protein, 339 aa, Brassica nigra
MLKQESNYNISNRENNRGPRACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSHNHNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFENTIRYASRKAYAERRPRINGRF

SEQ ID NO: 243 - protein, 339 aa, Brassica nigra
MLKQEINYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSHNHNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 244 - protein, 343 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 245 - protein, 343 aa, Brassica nigra
MLKQESNYNISNRENNRGARACDTCRSTICTVYCHADSAYLCNSCDAEVHSANRVASHHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 246 - protein, 344 aa, Brassica nigra
MLKQESNYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSPNHNNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 247 - protein, 345 aa, Brassica nigra
MLKQESNYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSPNHNNNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 248 - protein, 345 aa, Brassica nigra
MLKQESNYNISNRENNRGPRACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNNNQNNELLFSDDYLDLADYNSSIDYKFTGQYNQPQHKQDCTVPQTNYGGDRVVPLQLEETRGNVRHKKEKITYGSSGSQYNYNDSINHDAYNPSMETDFVPEPTARETTVSHQKTPKIHQLPEPLVQILSPMDREARVLRYREKKKRRKFEKTIRYASRKAYAERRPRINGRF

SEQ ID NO: 249 - protein, 345 aa, Brassica nigra
MLKQESNYNISNRENNRGPRACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNNNQNNELLFSDDYLDLADYNSSIDYKFTGQYNQPQHKQDCTVPQTNYGGDRVVPLQLEETRGNVRHKKEKITYGSSGSQYNYNDSINHDAYNPSMETDFVPEPTARETTVSHQKMPKIHQLPEPLVQILSPMDREARVLRYREKKNRRKFEKTIRYASRKAYAERRPRINGRF

SEQ ID NO: 250 - protein, 345 aa, Brassica nigra
MLKQESNYNISNRENNRGPRACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNNNQNNELLFSDDYLDLADYNSSIDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 251 - protein, 343 aa, Brassica nigra
MLKQESNYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETGGNVRHKKEKITYGSSGSQYNYNDSINHDAYNPSMETDFVPEPTARETTVSHQKTPKIHQLPEPLVQILSPMDREARVLRYREKKKRRKFEKTIRYASRKAYAERRPRINGRF

SEQ ID NO: 252 - protein, 342 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRRAYAERRPRINGRF

SEQ ID NO: 253 - protein, 347 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTTVTEPEKRAVIVQDDEEGKEDAKETASWMFPYSDKGSHNHHNNNNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 254 - protein, 343 aa, Brassica nigra
MLKQESNYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSPNHNNNNNNNNNQNNELLFSDDYLDLADYNSSMDYKFTGQYNQPQHKQDCTVPQTNYGGDRVVPLQLEETGNVRHKKEKITYGSSGSQYNYNDSINRNAYNPSMETDFVPEPTARETTVSHQKTPKIHQLPEPLVQILSPMDREARVLRYREKKKRRKFEKTIRYASRKAYAERRPRINGRF

SEQ ID NO: 255 - protein, 344 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTTVTEPEKRAVIVQDDEEGKEDAKETASWMFPYSDKGSHNHHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 256 - protein, 343 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNSENNRFSVGEEYLDLVDYSSSMDKRFTGQANQYQQDYNVPQRSYVADGVVPLQVGVSKGHMHHEQHNFQFGFTNVSSEAHQISNGSPIHMVSLVPESVTSDATVSHQRSPKSGTEELPEAPVQMLSPMERKARVLRYREKKKTRKFEKRIRYASRKEYAEKRPRIKGRFAKRNEVDADQAFPTVVMFDTGYG

SEQ ID NO: 257 - protein, 336 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYG

SEQ ID NO: 258 - protein, 340 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTG

SEQ ID NO: 259 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNNNISENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYG

SEQ ID NO: 260 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYG

SEQ ID NO: 261 - protein, 335 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSETAEPENIVVVGQEEEDEAEAASWLLPSSVKNCGDNNNNSENNRFSVGEEYLDLVDYSSSIDKRFTGQTNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 262 - protein, 338 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 263 - protein, 339 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 264 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEAHQISNGSPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 265 - protein, 335 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSETAEPENIVVVGQEEEDEAEAASWLLPSSVKNCGDNNNNSENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 266 - protein, 338 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDHNNNNNSENNRFSVGEEYLDLVDYSSSMDKRFTGQSNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 267 - protein, 339 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 268 - protein, 339 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVRMLSPMERKARVLRYREKKKTRKFEKRIRYASRKEYAEKRPRIKGRFAKRNEVDADHALSTMVVFDTGYG

SEQ ID NO: 269 - protein, 336 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNSENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 270 - protein, 338 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 271 - protein, 338 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPETVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 272 - protein, 417 aa, Arabidopsis thaliana
MMKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLLSEQFLNDVVEPKIEFPMIRSGLMIEEEEDNAESCLNGFFPTDMELEEFAADVETLLGRGLDTESYAMEELELSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 273 - protein, 406 aa, Zea mays
MVPLCGFCGKQRSMIYCRSDAASLCLSCDRSVHSANALSRRHRRTLLCDRCGLQPASVRCLEDNTSLCQNCDWNGHDAASGASGHKRQAINCYSGCPSSAELSRIWSFIIDIPTVAAEPNCEDGLSMMTIDDSDVTNHHGASDDKRLLEIANTALMSDPPSPDKLKPLIGSSSGDGFDVLPLATDQPAGPVSATPKVPYARDDNKFNDGMYEDLCVDDADLTFENYEELFGTSHIRIEELFDDAGIDSYFEMKETPPFDFNEQPKIVQLQCSDVVPADCAMSNTGERADSSLCIPVRQVRSSISHPLSGLTGESSAGDHQDCGVSPILLMGEPPWYSPGPEGSLAGGSRDSALTRYKEKKKKRMFDKKIRYASRKARADVRKRVKGRFIKAGEAYDYDPLSQTRSY

SEQ ID NO: 274 - protein, 405 aa, Arabidopsis thaliana
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNADKRPRMKGRFVKRSSIGVAH

SEQ ID NO: 275 - protein, 373 aa, Chrysanthemum x morifolium
MLKQESNDIGSGENNRARPCDTCRSNACTVYCHADSAYLCTSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 276 - protein, 408 aa, Oryza sativa Japonica Group
MGALCDFCGEQRSMVYCRSDAASLCLSCDRNVHSANALSRRHTRTLLCDRCASQPAMVRCLVENASLCQNCDWNGHSAGSSAAGHKRQTINCYSGCPSSSELSKIWTFVSDIPNVAPEPNCEQGISMMSISDSGVSNQDNAAGDSSLLDIASATLMSDLGTAGKPKSLIGSSSEAGVNLLPLATDQMAGSVDSTSAKVPYTADQDMFSKDSIYEDFCVDDVDLSFENYEELFGTSHIQTEQLFDDAGIDSYFESKEIPSGNSDEQPKLMQPVTSNAVSADSGMSIPGAKGDSSLCIPVRQARSSISLSFSGLTGESSAGDYQDCGVSPVLLMGEPPWHPPGPEGSFAGATRDDAITRYKEKKKRRKFDKKIRYASRKARADVRKRVKGRFVKAGEAYDYDPLCETRSY

SEQ ID NO: 277 - protein, 368 aa, Hordeum vulgare subsp. vulgare
MNCNFNSDLLEKEAGRTSFPWARPCDGCHAAPSAVYCCADAAYLCSSCDTQVHSANRVASRHERVRVCETCESTPAVLACHADAAALCTACDAQVHSANPIAQRHQRVPVLPLPAVAIPAASGFAEAEASVTAHGDKEGGEEVDSWLLRRNSDDNNCANKIDRYFNLVGYNMYYDNITCDPRPQEQYRMQEQQHVQNRYREKEGCECVVPPQVVMASEQQGSNYGTIGAGQAASVTAMASTYTASISNDISFSSMEVGIVPDNTRPNISNRNILTSSEAIELSGHSLQMPVHFSSMDREARVLRYKEKKQARKFQKTIRYATRKAYAEARPRIKGRFAKRSDIEHEENHMLSPPALPDTSSYNTVPWF

SEQ ID NO: 278 - protein, 329 aa, Hordeum vulgare subsp. vulgare
MIKAEPDLRGQLRGSAGVGGMQLQQRCDSCRSAPCAFYCRADSAALCAACDADVHSANTLASRHRRVPMGAVAPASPAGGAFVVRPGGVNSSWPIREGRRSYYDDREGEEEEATSWLLLDPLRGSEADAPAFGDALVADFLDLGRAGEKEASSKDYHGHGMESNEGSHDHELVVPGEPVAQLHERQGFTAEMAYDAQNSNHGYGFGATFERSLSMSSSPDNSSTVQDVSSSYMRRSESSVDLFSTAAHTSPQFMGMAMDREARVHRYREKRKMRRFEKTIRYASRKAYAETRPRIKGRFAKRADADLEVDQYFSAAALSDSSCGVVPTF

SEQ ID NO: 279 - protein, 329 aa, Hordeum vulgare subsp. vulgare
MIKAEPDLRGQLRGSAGVGGMQLQQRCDSCRSAPCAFYCRADSAALCAACDADVHSANTLASRHRRVPMGAVAPASPAGGAFVVRPGGVNSSWPIREGRRSYYDDREGEEEEATSWLLLDPLRGSEADAPAFGDALVADFLDLGRAGQKEASSKDYHGHGMESNEGSHDHELVVPGEPVAQLHERQGFTAEMAYDAQNSNHGYGFGATFERSLSMSSSPDNSSTVQDVSSSYMRRSESSVDLFSTAAHTSPQFMGMAMDREARVHRYREKRKMRRFEKTIRYASRKAYAETRPRIKGRFAKRADADLEVDQYFSAAALSDSSCGVVPTF

SEQ ID NO: 280 - protein, 441 aa, Oryza sativa Indica Group
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSDNNNNNNNNNDNDNKDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRRMQRHDPGSRAVSPRDQMCRSKWTRCSPLQLYLTVAMVLFHGSDGTHETLSYRHIYGDLLSSNNIDPVGVVLDNLCYE

SEQ ID NO: 281 - protein, 380 aa, Olea europaea
MLKEKSRGVHGGNTSSHWARICDTCQSAVCTMYCRADSAYLCTGCDSRIHRTSPEASRHQRMWVCEACERAPAAFLCKADAASLCITCDSDIHSAQPLARRHQRVPILPIPGMLCGTPSAPYPSGLVMGPTGVAAKIEFLTQDEDQTIHEEEDEDEAASWPLFNHVKNICNQSNNIGRFFGGEVDEYLDLDEYNSYQDNQFSNQDNNQLQPYDVSQKSYGSDNVVPIQYGKSKDQIHNHGFQLGREYEASKNVYDNPASISHTVSFSSLDVGVVPESTTSEVSVPHPRPPKGTIDLFSSPPIPMPTQLSPMDREARVLRYREKKKARKFEKTIRYASRKAYAETRPRIKGRFAKRTDVRANQMFSSTLIEEGGYGIVPSF

SEQ ID NO: 282 - protein, 372 aa, Sinapis alba
MLKPESYNISNRENNRGARACDTCQLTICTVYCHADSAYLCTSCDAQVHSANRVASRHKRVRVCESCERAPAAFMCEADDVSLCTACDSEVHSANPLARRHQRVPVVPITGNSCSSLATHHTTVTEPEKRAVLVQDDQEGKEDAKETASWMFPYSDKSNHNHNNNNNNQNNELLFSDGYLDLADYNSSMDYKFTGQYNQHQNKQDCTVPQTNYGGDRVVPLQLEETKGNLRHKEHNITYGSSGSQYNYNGSINHNAYNPSVETDYVPEPTARDTTVSHQKTPKGAIHKQPEPLIQILSPMDREARVLRYREKKKRRKFEKTIRYASRKAYAERRPRINGRFAKMSETEAEDQDFNTMLMYYDTGYGIVPSFY

SEQ ID NO: 283 - protein, 330 aa, Arabidopsis thaliana
MEARCDFCGTEKALIYCKSDSAKLCLNCDVNVHSANPLSQRHTRSLLCEKCSLQPTAVHCMNENVSLCQGCQWTASNCTGLGHRLQSLNPYSDCPSPSDFGKIWSSTLEPSVTSLVSPFSDTLLQELDDWNGSSTSVVTQTQNLKDYSSFFPMESNLPKVIEEECSGLDLCEGINLDDAPLNFNASNDIIGCSSLDNTKCYEYEDSFKEENNIGLPSLLLPTLSGNVVPNMSLSMSNLTGESNATDYQDCGISPGFLIGDSPWESNVEVSFNPKLRDEAKKRYKQKKSKRMFGKQIRYASRKARADTRKRVKGRFVKSGETFEYDPSLVM

SEQ ID NO: 284 - protein, 444 aa, Populus trichocarpa
MVTHKSKTKETVPCDFCSEQTAVLYCRADSAKLCLFCDQHVHSANLLSRKHVRSQICDNCSTEPVSFRCSTDNLVLCQECDWDAHGSCSVSASHDRTTIEGFSGCPSALDLASIWGFDLEEKKPEPLIENWSNNSCGVIHDLVNEPWVYDKSSGNLTFQDLMVPNENNNNGNRNIDNSPSCGKYKHVICKQLFELFKRDLIGGGVEGEGCGFGDGEGCGFGGGDGGGETLVTQSRSGWRSGVKGVQFGNGNDGERISCVFNNDSGLLLLQVWDFHLGQLRNHDESGQLEIEYVANDAGFVIKDFGELMKETSSTSPKMLGDMYQMNCSTAHDDMTQGPATSESNNLPIVRSGFSKPRCSSSSNDVQFMEQSILIRGEGLKMEAATKVDMELLARNRGDAMQRYKEKKKNRRYDKHIRYESRKARADTRKRVKGRFVKTTEAPDS

SEQ ID NO: 285 - protein, 447 aa, Populus trichocarpa
MICNKSLANAVGGRTARACDSCIKKRASWYCAADDAFLCQACDSSVHSANLLARRHERVRLKSASLKSSDAGSKENSMPSWHGGFTRKARTPRHGKPVSRSKIEETTRNIPIPLVPEVGSDEISLEDNEEEHLLYRVPIFDPFAAELCTSTTVSNEAGAVVPAGGTDTDQRAADSSGTESKVLLGGSEGKDVESLHGFLPSDMDLAEFAADMESLLGRGLENESFGMEELGLMDCKEENELGVKGYPLGNGKVKVEEEEDAGMEEKAVRECHADIEIDIAKDPPFELSFDYDSPATCVEEDEKVGIEEGDLKNSDGEYEDDGGAKKKRRTLLSLDYEAVMTAWASQGSPWTNGYRPDFDADECWPDADCMGICGAQLHHPYGDVSGLGAHPAALVDGGREARVSRYREKRRTRLFSKKIRYEVRKLNAEKRPRMKGRFVKRTTFAGK

SEQ ID NO: 286 - protein, 393 aa, Populus trichocarpa
MISGRKAANAMGGKTARACDSCLRKRARWFCVADDAFLCQACDASVHSANQLASRHQRVRLETASSYRISSSLNTDQDYSPPAWHQGFTRKARTPRHNSNKSLLVQQLLKDDREKVLNPLPLVPEIGSEEEPNMAPDENEDDQLLCRVPVFDPFAAKMCDIVTSEDENMVVEVYGQEGACGLDNLPGFLPSDMDLAEFAADLLDCSKGEDEGQFCFADKVVKMKDEQEMETIIDCHFDQDFNMARESLLDEEVEEKKVPVPETEMMNSTGYKEMKRNVSLRLDYESVIIAWANQGCPWTTGSRPELNPDDSWTDSMGACPKDVNNPYGGLGSHTRGGDGEREARVMRYKEKRRTRLFSKKIRYEVRKLNAEKRPRMKGRFVKRTSLMGTTDFP

SEQ ID NO: 287 - protein, 379 aa, Populus trichocarpa
MGYVCDFCGEQRSMVYCRSDAASLCLSCDRNVHSANALSKRHSRTLLCERCNSQPALVRCAEERISLCQNCDWIGHGTSTSASTHRRQTINSYSGCPSASELSSIWSFVLDFPSRGESTCEQELGLMSIAENSTTDSWGPTENTIGQNASGVVEVNDRREIAKSGVWLGSSSIPESSSVPNNLDQTTRSANTSLPKDFNMDEMDLSLENYEELFGVTLNNSEELLENGGIDSLFGTKDMSVVNAVQPASSNAASADSMMSNKTEPILCFTEKQGHSSLSFSGLNVESSAADYQDCGASSMLLMGEPPWCPPCPESPFSSANRSDAVMRYKEKKKTRMFEKKVRYASRKARADVRRRVKGRFVKAGEAYDYDPLSQTRSF

SEQ ID NO: 288 - protein, 432 aa, Vitis vinifera
MISEKNVANAVGGKTARACDSCIRKRARFYCAADDAFLCQACDMSVHSANPLARRHERVRLKTASLKLPGADSLENSMPSWHQGFTRKARTPRHGKPAAHPAFKSDELTRNPLPFVPEIGADETSYDDNEEQLLYRVPIFDPFVAELCASTNSNEAVTTVANDTETADVTGSETKALVAGRGHDVDSLHGFLPSDMDLAEFAADVESLLGKGLDNESFGMEGLGLIDCKEKESVEYSLHSGRVKLEEEEDIGGVMACQADAEIDMTREPFELNFDYGSPATCEEEEEKVAVGAMDMNNKVDDPKKKNKILLRLDYEAIITAWASQGSPWTNGHRPELDPDDCWPDCLGTCGIQVHHPYGEFGGMGEQQAAMGDGGREARVSRYREKRRTRLFSKKIRYEVRKLNAEKRPRMKGRFVKRASFGGPAAFPLLNK

SEQ ID NO: 289 - protein, 474 aa, Vitis vinifera
MVSPKPSNGERVPCDFCSGQIAVLYCRADSAKLCLFCDQHVHSANALSRKHLRSQICDNCSSEPVSVRCSTDNMVLCQECDWDAHGSCSVSAAHDRKPVEGFSGCPSAVQLSSIWGLDIEEKKAPLPPPPSMAVDSWVYKSNTLTFQDLMVPNGNAVAFPDALGGEVSKRQSPSCGKHKQVIFKQLVELFRRDLLAGNGGGGGIVGDDEDDGGGGVCGGGENLVTGWQGHVGESIGIENGGVLDVDHQALEQQTPFTSLLMLPNRATTGGVILWDNNPSDQSTQIWDFHLGHSRGYEECGLLEAEYGVNDAGFVIKSYSELMKETSFTNTKVVGEMYDINYSMTHEDITSFNNNSNNPTASQGAATSESNNLPIARPSSGSAFAKPKSFSGSKDIELTEQSILMRGESGRTAATTKVDLEQLAQNRGNAMLRYKEKKKTRRYDKHIRYESRKARADTRKRVKGRFVKATEAPDG

SEQ ID NO: 290 - protein, 529 aa, Vitis vinifera
METTSKSRPSAAVPCDFCDSKTAVVHCRADSAKLCLLCDRHVHSANALSRKHLRSQICDNCRTEPVSFRCFTDNLALCQSCDWDSHGNCSVPSLHERTPVESFSGCPSPLELASVFRVDLKDGNWSSWNFGSVNVQDFVVPGENCYAGCGTKVEKNGISVVYEQLVDLIRSDVDVVRGDVDGDGDEGEDGAELGPGTPGRCANMGNFQGVDLDNGDDEELLRQQTPFTSLLMLPTPVDARDTGCGYGCAVEGDAMWDRGHLSYQAPQSQIWDFHLGRSRICKETSPEAGYDVDNSGFVIKNYSEITKGSSLTRTKALQGMYEMNCTTTHEDILSKNCPLGHGSMIYSKTGGLGTPLNHVAICKGLEFCSCCPFEKHTSHYCCEFSEDTGTPDGGNGIGVIVAPFLKNVNKQRLYSHSNKALSSQGPTTAESNNIPIVGPSSESWTAEPNTNSIKSMQFKDLLIGSGTARTETTNVDMELLAQNRGHAMLRYKEKKKTRRYEKHIRYESRKARADTRKRVKGRFVKASDS

SEQ ID NO: 291 - protein, 391 aa, Vitis vinifera
MLKDEGCNADAAAGGGGGWARVCDTCRSAACTIYCRADSAYLCAGCDARIHAANRVASQHERVWVCESCERAPAAFVCKADAASLCATCDADIHSANPLARRHHRVPVLPIAGCLYGPPATDPGGTVVRSAAEADNGFLGQEAEETIDEEDEDEAASWLLLNPVKNNNGSSNNQNNGLLFGGEVDEYLDLVEYNSCPENQFSDQYNQQQPPPHYSVPHKNYGGDRVVPVQCGEAKGQLHQQHQQQGFHLGMEYESSKAAYSYNPSISHSVSVSSMDVGVVPEATTMSDISISISHPRPPKGTIDLFSGPPIQMPTQLTPMDREARVLRYREKKKTRKFEKTIRYASRKAYAETRPRIKGRFAKRTDVEVEVDQMFSTTLMAESGYGIVPSF

SEQ ID NO: 292 - protein, 410 aa, Vitis vinifera
MITDKKVANAMGGKTARACDNCLHKRARWYCGADDAFLCQACDASVHSANQLAERHERVRLQAASCKNADSMRDNSTPAWHQGFTRKARSPRNVKRTSVQPSKHENKFPTPPPLVPEIGSEEASPDENEEQFLFRVPTFDPFVAELNNDGIREIGMENDSKPLSDYGHEEIGDLDSLTGFLPSEMDLAEFAADVESYLGAGLDEDSCGIKGIGVLDCEQGDMDACFGDQKVKVKEERVETDATFHLDPELDMTKELLAWNLDYESTVMDEEEHEEKMVAAVEMRRKISLSLNYEDVITAWASQGSPWTTGNRPEFDPNDYWPDYMGACPTNVHGPCGDVGGVGGNFGGRDGGREARVLRYREKRRTRLFSKKIRYEVRKLNAEKRPRMKGRFVKRASFAAGPCFPILNVK

SEQ ID NO: 293 - protein, 401 aa, Vitis vinifera
MGQLCDFCGDQRSMVYCRSDAACLCLSCDRNVHSANALSRRHSRTLLCERCNSQPATVRCVEEKISLCQNCNWIGHGSTTSASDHKRQTINCYSGCPSAAELSRIWSFVLEFLSVDDSNCEQGMVLMSLTENSVGSCSLPPVNNNINDSTVAGRTNAQENVDKSDLWMASSPVPALNPISSSVDQPTDLVNSPTTKLCCSGICDDDDLLYEDFSMADVDLSIENYEELFGVSQNHSEQLLENGGIDSLFGIGNLPAGSCQEPLTMQPACSNPISADSIISSKTDPNLCFPPRQAHSSLSLSFSGLTGESSTGDYQDCGVSSMLLMGEPPWCSPCPENSLPSANRDSAVLRYKEKKKARKFEKKIRYASRKARADVRKRVKGRFVKAGDAYDYDPLNQTRSF

SEQ ID NO: 294 - protein, 410 aa, Solanum tuberosum subsp. andigena
MLKKEKSGGFDGSSNNWARVCDSCHSATCTVYCRADSAYLCAGCDSRIHAASLMASRHERVWVCEACERAPAAFLCKADAASLCASCDADIHSANPLARRHHRVPIMPIPGTLYGPPAVHTVSGGSMMIGGTTGEGTEDDGFLSLTQDADDTTIDEEDENEAASWLLLNPPVKNNNKNNINNNNNNQNNNYGMLFGGEVVDDYLDLAEYGGDSQFNDQYSVNQQQQRYSVPQKSYVEDSVVPVQNGQRKSLILYHQPQQQQQQSHHLNFQLGMEYDNSNTGYGYPASLSHSVSISSMDVSVVPESALSETSNSHPRPPKGTIDLFSGPPIQIPPQLTPMDREARVLRYREKKKNRKFEKTIRYASRKAYAETRPRIKGRFAKRTDVEAEVDQMFSTQLMTDSSYGIVPSF

SEQ ID NO: 295 - protein, 413 aa, Zea mays
MTSAGAATGAALGARTARSCDGCMRRRARWHCPADDAFLCQTCDVSVHSANPLARRHHRVRLPSASCSSPPRDPDAPTWLHGLKRRPRTPRSKPGGSKSNKHEATPSFIAAAASSAAVPDLEAEESGSGILGGNDDHHGFLQDDDEDLLYRVPVFDPMLAEFYNPVADEGEQKPACSLLMPSLAETSPEFASGGSAEADGLSVSFHVPDMELASFAADMESLLMGVDDDGFDCLGFLDEEKPQVNADLDAIVAPAPEPEDKKRKRPEMILKLNYEGVIASWVRDGGSPWFHGERPHLDCHELWSDDFTTGSRELLGGAVTPVTGGEREARVSRYREKRRTRLFAKKIRYEVRKLNAEKRPRMKGRFVKRATLPPLPRPPPPQQQQQQKQLPRAPPHVGMVLPPPPVSNGRLWF

SEQ ID NO: 296 - protein, 452 aa, Zea mays
MIATTRGSSAKAAAAVGGKAARACDGCLRRRARWYCAADDAFLCQGCDTSVHSANPLARRHERLRLCPASPLQTPPDRSAAAAATATNKRERHDEVAVPAWFGRKARTPRGGHAKSVGQVALSRRLVVPHAAGGDSDSPDERNGGEEEQLLYRVPILDPALAEFCSPPPLEDAAGLALDASVCNEDGAIEDPAKPDPAAPLAQFCPVSGHFNFGPTDAELREFAADMEALLGHGLDDGNEEDSSFYMETLGLLDPMEVGDDATQVKVETDGSSACCEASGTLACGLELDLEASDEMLDIDFDYASPQDTATDERAASSDTGADAQFLQTSLSLTLNYEAIIQSWGSSPWTGGGERPHVKLDTRWPHDYTNMWVVGGVVGHGGEDLPGTPRLGMDGGREARVSRYREKRRTRLFSKKIRYEVRKLNAEKRPRMKGRFVKRATAGGSLAIAGLA

SEQ ID NO: 297 - protein, 364 aa, Zea mays
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGTGEAAASEADEQHAAAEHAHAHALNLNVEAKDMKLDYLFSELDPYLSVEIPRFQHADSVVPNGAGAAVELDFTCGIGVKHSSYSSYTATSLAHSGSSSEVGVVPEAFGGSGSGGGSFELDFTRPKPQAYMPYTGTPQSHSVPSADVEVVPERGDLAAVRPVPLMGESREARLMRYREKRKNRRFEKTIRYASRKAYAETRPRIKGRFAKRADHDGDADADDAEAEAEAEAAVPMSYVLDFGYGVVPSF

SEQ ID NO: 298 - protein, 407 aa, Zea mays
MGALCDFCGEQRSMVYCRSDAASLCLSCDRNVHSANALSRRHTRTLLCDRCASQPAMVRCLAENASLCQNCDWNGHIAGSSSAGHKRQTINCYSGCPSSAELSRIWSFVSDIPNVAPEPNCEQGISMMSISDSGVSNQDNAAGDSILLDIASATLVSDIGTCDKLLVGSSSGAGVNLLPLVTGQTETAGSVDSTPDKVPYTPDKDMFSKDSIYEDFCVDDADLAFENYEELFGTSHIQTEQLFDDAGIDIYFEMKEAPAGNSTESKLKQPANSNAVSADSGMSNPGVKGDSSVCTPLRQARSSLSLSFAGLTGESSAGDNQDCVVSSLLLMGEPPWQPPGPEGSIAGGSRDSALTRYKEKKMRRKFDKKIRYASRKARADVRKRVKGRFVKAGEAYDYDPLCQTRSY

SEQ ID NO: 299 - protein, 456 aa, Zea mays
MIATTTTGSSAKAAAVGGKEARACDACLRRRARWYCAADDAFLCQACDTSVHSANSLARRHERLRLRPTSPLQTPPPPTPASAKRESHDEVVPAWFKRKARTPRGGRAKSDVRTLSRRLVVPHAAGGDSPDGRNDEGEFEAEEPEEEVLYRVPVFDPALAEFCSPQPLEDAAALASSCNEDGAVEDPAKTDRETPAAAPLVQFFPDGGHANFGPTDAELREFAADMEALLGYGLDDGNEESSSFCMETLGLLEPVEVGEDASRVKVETDAGSACEASGTLACALELLDPDASDEMLDIDFNYGSPQDTTTTENAASSSHTGTDGQFLQTSLSLTLNYEAIIQSWGSSPWTGGAERPHVKLDDSWPHDCTNMWVVGRGMVGHGGEDLLGTPRLGQGMDDVGREARVSRYREKRRTRLFSKKIRYEVRKLNAEKRPRMKGRFVKRATAGGSLTIAGLA

SEQ ID NO: 300 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 301 - protein, 348 aa, Brassica nigra
  misc_feature (321)..(321): Xaa can be any naturally occurring amino acid
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAXRNEVDADQAFPTVVMFDTGYGIVPSFS

SEQ ID NO: 302 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTRYGIVPSFS

SEQ ID NO: 303 - protein, 348 aa, Brassica nigra
MLKQESNWAQACDTCRSAACTVYCRADSAYLCTSCDAQIHAANRLASRHERVRVCESCERAPAVFFCQADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 304 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 305 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSIIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 306 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSETTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 307 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 308 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADQALSTMVVFDTGYGIVPSFS

SEQ ID NO: 309 - protein, 342 aa, Brassica nigra
  misc_feature (15)..(15): Xaa can be any naturally occurring amino acid
  misc_feature (31)..(31): Xaa can be any naturally occurring amino acid
  misc_feature (40)..(40): Xaa can be any naturally occurring amino acid
  misc_feature (113)..(113): Xaa can be any naturally occurring amino acid
  misc_feature (315)..(315): Xaa can be any naturally occurring amino acid
MLKQESNWAQACDTXRSAACTVYCRADSAYXCTSCDAQIXAANRLASRHERVRVCESCERAPAAFFCKADAASLCTACDSQIHSANPLARRHQRVPILPISGCVATNHHSSEXTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAXRNEVDADHALSTMVMFDTGYGIVPSFS

SEQ ID NO: 310 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 311 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNNNISENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMVDTGYGIVPSFS

SEQ ID NO: 312 - protein, 342 aa, Brassica nigra
  misc_feature (177)..(177): Xaa can be any naturally occurring amino acid
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFXGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 313 - protein, 344 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDHNNNNNSENNRFSVGEEYLDLVDYSSSMDKRFTGQSIQYQQDYNVPQRSYVADGVVPLQVGVANGHMHHKKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 314 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDANHALSTMVMSDTGYGIVPSFS

SEQ ID NO: 315 - protein, 345 aa, Brassica nigra
  misc_feature (344)..(344): Xaa can be any naturally occurring amino acid
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSXS

SEQ ID NO: 316 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 317 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGLSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 318 - protein, 420 aa, Sorghum bicolor
MTTSAGAAAGAALGARTARSCDGCMRRRARWHCPADDAFLCQTCDVSVHSANPLARRHHRVRLPSASCSSPPCDPDAPTWLHGLKRRPRTPRSKPGGGKHEATTPNSMAAAASAAVPDLEAEESGSGIVGDNDDHGFLVDDDEDLLYRVPVFDPMLAEFYNPVADEGEQKPLAEFYNLVADEGEQKPACLMPPLVETSPEFASGGLAEADGLSGFDVPDMELASFAADMESLLMGVHDGFDDLGFLDEEKPQVNADAYLEAMAAPVPEREDKKRKRPEMILKLNYDGVIASWVRDGGSPWFHGERPHLDPYELWSDFPAGSRGLLGGAVTAVTGGEREARVSRYREKRRTRLFAKKIRYEVRKVNAEKRPRMKGRFVKRTTLPPLPRPPPQQQQKQLPRALPHVGMVLAPPPGANGRFQF

SEQ ID NO: 319 - protein, 376 aa, Sorghum bicolor
MEALVAGRYWGVGGRRCEACGGSPAAVHCRTCPGGGAYLCAGCDAGHARAGHERVWVCEVCERAPAAVTCRADAAALCAACDADIHDANPLARRHERVPVQPIGAAAAAPAAETLLFGAAAEENQDDDDGAAAAAKVVGVDAGKLADFLFADVMDPFFGQDFTGILRRRVALWTLTFGGGVAAAAVAAKPSYSSYTAASLGHSGSSSEVGLVPDAMCGRGGSVTGGVIELDFAQSKAAYLPYAATPTHSMSSLDVGAVPERGDGVMAGRVATPPAAAAAESREARLMRYREKRKNRRFEKTIRYASRKAYAESRPRIKGRFAKRADDNDADADADFDFDAGAAAATAPARSRSQQQQPSYPYVLDFAAGYGVVPTF

SEQ ID NO: 320 - protein, 488 aa, Sorghum bicolor
MSSSKHAAAGAGAVGGKAARACDSCLRRRARWYCAADDAFLCQGCDASVHSANPLARRHERLRLRPMTSPPDPAHSTLEAGGVGVASTSTWKKRQQQQQQVAPAWSKRKARTRRPHVKSVGQLLSRKLVVVPEVATVESSEERKVEEEDEEEEEEEEQLLYCVPTFDRALAELCTPPPPLDDPTATASSSCCRDNDVDGAVDNAKAAPPAVVVAESPVQQLPDSFAGFGPTDAELREFAADMEALLGQGLGDSNELDESFYMESLGLMTTTQQAEDVDVGRVKMEPNGSVISRSRGEGAPGFGPAELMKPEASSAEVLVLDIDFNCSSPTVMMDHEDEDSFEHKASASNGDAAAAGTQFLKRSLDLSLNYEAIIESWGSSPWTDGQRPNVQLDDFWPHAHLTGWMAGGGRLGGEAAAVSPRLGMVGGREARVTRYREKRRTRLFAKKIRYEVRKLNAEKRPRMKGRFVKRPAAAGGGGAAIAAPCAVT

SEQ ID NO: 321 - protein, 406 aa, Sorghum bicolor
MASLCDFCGKQRSMIYCRSDAASLCLSCDRNVHSANALSRRHTRTLLCDRCGSQPASVRCLEDNASLCQNCDWNGHDAASGASGHKRQAINCYSGCPSSAELSRIWSFIMDIPTVPAEPNCEDGLSMMTIDDSDVTNHHDASDDKRLLEIANTTLMSDPPSADKPKPLISSSSGDGFDVLPLATDQPAGSVSVTPKVPYARDDDNFNDGMYEDLCVDDADMTFENYEELFGTSHIRTEELFDDAGIDSYFEMKETQPFDFNEEPKTMQLECSNVVSADCGMLNPGARADSSLCIPVRQVRSSISHSLSGLTGESSAGDHQDCGVSPMLLMGEPPWHSPGPEGSVAGGSRDSALTRYKEKKKRRKFDKKIRYASRKARADVRKRVKGRFIKAGEAYDYDPLSQTRSY

SEQ ID NO: 322 - protein, 329 aa, Sorghum bicolor
MEGDEKSAGGAPAYWGLGARPCDACGADAARLYCRADSAFLCAGCDARAHGAGSPNARVWLCEVCEHAPAAVTCRADAAALCASCDADIHSANPLARRHERLPVAPFFGALADAPKPFASSAAAVPPKATAGADDDGSSEAEAASWLLPEPDHGHKEEGATTEVFFADSDPYLDLDFARSMDDIKTIGVQGGPPELDLNGAKLFYSDHSMNHSVSSSEAAVVPDAAAGAAPVVAVVSRGLEREARLMRYREKRKSRRFEKTIRYASRKAYAETRPRIKGRFAKRTPGAGEDPLEEHEEMYSSAAAAVAALMAPGGADADYGVDGVVPTY

SEQ ID NO: 323 - protein, 474 aa, Sorghum bicolor
MIATTGSSAKTAAAAAVGGKSARACDGCLRRRARWYCAADDAFLCQGCDTSVHSANPLARRHERLRLQPAAASSSPLHTPPRTGAAANNKRERHDEVVPAWFRRKARTPRGGHAKSVGGQALSRSRRLGVVVPHAAAGGGDSPDDGRSAEGEFEAEEEQLLYRVPIFDPALAEFCSPPPAPLEDAAALASSCNEDGAVEDPANSKPDPGPATPAPAPVVQFFPDSGHANFEPTDAELREFAADMEALLGHGLDDGNEEDSSFYMETLGLLDPVEVGDDATRVKVETDGGSACGEASGTLACALELLDPAEVSDEMLDIDFNYGSPLDTMMDDEKAASSDTGGADDAQFLQTSLSLTLNYEAIIQSWGSSPWTAGGERPHVKLDDSWPHTNMWVVGGVAGHGGEDLLLGTARLGMDGGREARVSRYREKRRTRLFSKKIRYEVRKLNAEKRPRMKGRFVKRATAGGSSLAIAGLA

SEQ ID NO: 324 - protein, 411 aa, Sorghum bicolor
MNYNFSSNALDEEEVAGRGGEGGSCAAAPAWARPCDGCRAAPSVVYCHADAAYLCASCDVRVHAANRVASRHERVRVCEACERAPAVLACRADAAALCVVCDAQVHSANPLAGRHQRVPVLPLPVAAIPAASVLAEAAATAVAVGDKQEEEVDSWLLLTNTKDPVSDNNNCNCSSSSNNNISSSNTSTFYADVDEYFDLVGYNSYCDNHINSNPKQYGMQERQQQQQLLLQKEFGDKEGSEHVVPASQVAMANEQQQSGYGVIGVEQAASMTAAVSAYTDSITNSISFSSSMEVGIVPDNMATTTDMPNSGILLTPAEAISLFSSGSSLQMPLHLTSMDREARVLRYKEKKKSRKFAKTIRYATRKTYAEARPRIKGRFAKRSSDMEIEVDQMFSSAALSSDGSYGTVLWF

SEQ ID NO: 325 - protein, 406 aa, Sorghum bicolor
MGALCDFCGEQRSMVYCRSDAASLCLSCDRNVHSANALSRRHTRTLLCDRCASQPAMVRCLAENASLCQNCDWNGHIAGSSAAGHKRQTINCYSGCPSSAELSRIWSFVSDIPNVAPEPNCEQGISMMSISDSGVSSQDNAAGDNNLLDIASETLISDLGTCDKPLVGSSSGAGVNLLPLATDQTAGSVDSPPDKVPYTPDKDMFSKDSIYEDFCVDDVDLAFENYEELFGTSHIQTEQLFDDAGIDSYFEVKEAPAGNSTEQSKLKQPANSNAVSADSGMSNPGVKGDSSVCIPLRQARSSLSLSFSGLTGESSAGDHQDCVVSSLLLMGEPPWQPPGPEGSIAGGSRDSAITRYKEKKKRRKFDKKIRYASRKARADVRKRVKGRFVKVGEAYDYDPLCQTRSY

SEQ ID NO: 326 - protein, 426 aa, Ricinus communis
MEEYSDSAPRNSLFVRLCDFCNSEAAILYCRADSAKLCLFCDQQVHSANALSLNHFRSLNCDKCGAEPASVQCSVINDNNNNDLVLCQDCDFDCSVSLSLLKRAHINGFMGCPNAVELGEILGFDLKKTKLFASSDSGSDLYDQEMDNMQDLLVPSGNSSRNCRQEMYKQLLELGKRERVKVNGDGDGEELRPETPPSRCGQQGNLVNLQMKNGNEEEFHHQERPFASMLMLPNLEDVRESDGAADGVLLWDCNPTYQAAQVWDLDLGKTRDCAEPGEEEANYDATDPGFTFNNHRISKDSAFNIIKVCSKQQVLQSTMETGGGKDTLLVEQSSDSLLAEAKSNNSPRHVEVVEKSHLAWVGTDDMETSKADVELFAQNRGNAMLRYMEKKKTRRYDKHIRYESRKARADTRERVKGRFVKASENC

SEQ ID NO: 327 - protein, 468 aa, Ricinus communis
MISNKNVANAVAGKTARACDSCVRKRARWYCAADDAFLCQSCDSSVHSANPLARRHERVRLKISSLKSLDIISKGSSVITVPSWHQGFTRKARTPRNGHGNKPLLSLLKIEEKSRNPIPLVPEVGSDDQISHEDNNEEEQLLYRVPIFDPFVAELCTPTTISNEADQTTTAPFTAGGGNGNDTDQTVAGANGIESKASYLHGFLPSETDLADFAADVESLLGRGLENESFGMEDLGLVDCKEEKQFKMQEREFSLASGQVIKLEEEEKEEEEAVRECHIDTEIDMAKEPPFELSFDYDSATCGEEDEKVATPQRDIKSNNGEYKDNTRSKNDNKKKRKILLSLDYEAVITAWATQGTSPWTDGTRRDVDPDECWQDCMGTCGAEFHHPYGDTNGLGGVGGGGNPAMAGGGREARVSRYREKRRTRLFSKKIRYEVRKLNAEKRPRMKGRFVKRATFAGGPSAFPLHAK

SEQ ID NO: 328 - protein, 378 aa, Ricinus communis
MLKEENTGGGGGNNWARVCDTCRAAACTVYCKADSAYLCATCDARIHAANRVASRHGRVWVCEACERAPAAFLCKADAASLCATCDADIHSANPLARRHQRVPIHPISGCLHGPQAGPVGGGGETTTEDMFMTEDGEDGVGEEEEDEAASWLLLNPVKNGNSQNNGTNGFLFGGEVEEYLDLFEYNSNSCGENQYADNHQHYSGTVHQKSHEGDSVVPVRCGDGAGKDHVHQQYHNFQLGLEFESSKAAYSYNGSISHSVSISPMDVGVVPDSTMSEASISHPRPPKGTIDLFSGPPIQMPSQLSPRDREARVLRYREKKKTRKFEKTIRYASRKAYAETRPRIKGRFAKRTDVEVEVDQIFSTALMAETGYGIVPSF

SEQ ID NO: 329 - protein, 430 aa, Ricinus communis
MTNDRKAANALSGKTARACDGCSRKRARWFCAADDAFLCQACDDSVHSANQLASRHERVRLETASSKISGSRNTVDSVPAWHQGFIRKARTPRNSSNKQQLKDEDKVLVMNPLPLVPEIGGEEEGNSTFADEDDDRLLYRVPVFDPYASELCTDDMVTCGEGTEITMGNEEGNIVFDGYNGQEGTCDDLDILPEFFSSDMDLAEFAADVENLLGVNEDSPDIEDLCLLHCKEEEDDQKCFFDDQDKVVMKVKDEQEVEACDHFDQAFERESLDWSFNYESPTITADEVEEKKRVPVAINSQQKKETKSTASLLRLNYEDVINAWASQGSPWTSGSRPELNSDDCWPDCMDICLKDGHHHPYGGMGGHTRGGNGAREARVLRYKEKRRTRLFSKKIRYEVRKLNAEKRPRMKGRFVKRTSFMGNGFPYMNK

SEQ ID NO: 330 - protein, 365 aa, Magnolia virginiana
MDGDSSTRRWARVCDSCRSAACTAYCRADAAYLCAGCDSRTHAANRVASRHERVWVCESCERAPAAVSCKADAAALCTACDVDIHSANPLARRHHRTPILPISGQLYSSPHESVHDREPGGAHEEDEDEDGDGDDEAASWLLLNPVKNSNQNNGYGYGGEVDEYLDLVGYNNSCNENQNEGQSIQLHQNLGKNEGDDSVVPVQFLAGDEQQQQQQQQQNLQLDLDMEFEESKAGYNYTASMSQSVSYSSMDASVVPDATAMTDISNSHVRPPKGTIDLFAGPPLQMMPAQFSPMDREARVLRYREKKKTRKFEKTIRYASRKAYAETRPRIKGRFAKRTDVEVEVHQMFSTTVMAESRYSIVPSF

SEQ ID NO: 331 - protein, 407 aa, Zea mays
MASLCDFCGKQRSMIYCRSDAASLCLSCDRNVHSANALSRRHTRTLLCDRCGSQPASVRCLEDNASLCQNCDWNGHDAESGASGHKRQAINCYSGCPSSAELSRIWSFITDIPTVAAEPDYEDGLSMMTIDGSDVTNRHDTSDDKRLLEIANTTLMSDPPSADKLKSPTGSSSGDGFDVMTLATDQPAGPVSATPKVPNARDDDKFNDGMYEDLCVDDADLTFEDYEELFGTSHIRTEELFDDAGIDGYFELKETPPFYFNEQPKAMQIECGNVVSADCAMSNPGARADSSLCIPVRQVRSSISHSLSGLTGESSAGDHHDCGVSPMLLMGEPPWHSPGGPEGSVAGGSRDSALTRYKEKKKRRKFDKKIRYASRKARADVRKRVKGRFIKAGEAYDYDPLSQTRSY

SEQ ID NO: 332 - protein, 374 aa, Glycine max
MGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 333 - protein, 365 aa, Glycine max
MGIERGGLKGFRSGWSVPPKKPCDSCKLASAALFCHLDSAFLCIACDSKIHCANKLASRHERVWMCEVCEQAPASVTCKADAAALCVTCDSDIHSANPLAQRHERVPVEPFFDSAESIVKASATASFGFVVPSDDGAASDVFAPDDSDSAAWLIPNPNFGSKLMDAPEIKSKEIFFSEMDPFLDFDYSNSFQNHNSAVNDSVVPVQTKPSLAPPPINNHQHHHQSETCFDIDFCRSKLSSFNYPSQSLSQSVSSSSLDVGVVPDGNTVSDMSYSSGIVVSGGQGATQLCGMDREARVLRYREKRKNRKFEKTIRYASRKAYAETRPRIKGRFAKRTEIDSDVERLYSPGAAALMLDTPYGVVPTF

SEQ ID NO: 334 - protein, 366 aa, Glycine max
MKDAGALGGKTARACDSCVSRRARWFCAADDAFLCHGCDTLVHSANQLASRHERVRLQTASSKVTTTHAWHSGFTRKARTPRHNSKHFALQQRLKDEVLFNNTSVLPLVPELGGEEQEPVVVDNDETEEQMLCRVPVFDPFDVRTDDLDSFSDMDFAEFAADVESLLDKEDDEISACVGGGEGEGEGVQGAMVKVKDEEEIDGDVACYLESVFDDAFHWNNIESVLSDAREEKEGVVACDVGVGDEEGGTKRDIFLRLNYDEVITAWSSQGSSPWTTSNPPKFNSDYDFSLGLSGVGGEVRSLRGHLDGGREARVSRYREKRRTRLFAKKIRYEVRKLNAEKRPRMKGRFVKRTCFVGANAFPAYH

SEQ ID NO: 335 - protein, 411 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSVSSSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 336 - protein, 411 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSDNNNNNNNNNDNDNKDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSVSSSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 337 - protein, 291 aa, Oryza sativa
MNYNFGGNVFDQEVGVGGEGGGGGEGSGCPWARPCDGCRAAPSVVYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNISFSSMEAGIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDSSYGTVPWF

SEQ ID NO: 338 - protein, 451 aa, Oryza sativa
MNYNFGGNVFDQEVGVGGEGGGGGEGSGCPWARPCDGCRAAPSVVYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNSSNNGMYFGEVDEYFDLVRYNSYYDNNNNDNSNSNSSNNDNDNDNDNNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSVSSSISFSSMEAGIVPDSTVIDMPNSSILTPAGAINLFSGPSLQMSLHFSSMDREARVLRYREKKARKFEKTIRYETRKAYAEARPRIKGRFAKRSDVQIEVDQMFSTAALSDSSYGTVPWF

SEQ ID NO: 339 - protein, 413 aa, Oryza sativa
MNYNFGGNVFDQEVGVRGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSNNNNNNNNNNDNDNDNNDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNRVSSSISFSSMEAGIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 340 - protein, 412 aa, Oryza rufipogon
MNYNFGGNVFDQEVGVGGEGGGGGEGSGCPLARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSNNNNNNNNNNNDNDNDNNDNNNSNSSNNGMYFGEVDEYFDLVGYNSYYDNRIENNQDQQYGMHEQQEQQQQQQEMQKVFAEKEGSECVVPSQITMLSEQQHSGYGVVGADQAASMTAGVSAYTDSISNSVSSSISFSSMEAGIVPDSTVIDMPNSSILTLAGAINLFSGPSLQMSLHFSSMDREARVLRYREKKKARKFEKTIRYETRKAYAEARPRIKGRFAKRSDVQIEVDQMFSTAALSDGSYGTVP

SEQ ID NO: 341 - protein, 415 aa, Oryza barthii
MNYNFGGNVFDQEVGVGGEGGGGGEGSGCPWARPCDGCRAALSVVYCRADAAYLCASCDARVHAANRVASRHERVRVCEACERAPAALACRADAAALCVACDVQVHSANPLARRHQRVPVAPLPAITIPATSILAEAVVATATVLGDKDEEVDSWLLLSKDSDNNNNNNNNNDNDNDNNNNSNSNSNSSSNGMYFGEVDEYFDLVGYNSYYDNRIENNQDQQYGMHEQQEQQQQQQEMQKEFAEKEGSECVVPSQITMLSEQQHSDYGVVGADQAASMTAGVSACTDSISNRVSSSISFSSMEASIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 342 - protein, 407 aa, Oryza longistaminata
MNYNFGGNVFDQEVGGGEGAAGGGGCPWARPCDGCRAAPSVVYCRADAAYLCASCDARVHAANRVVSRHERVRVCEACERAPAALACRADAAALCVACDVQVHSANPLARRHQRVPVAPLPAVAIPATSVLAEAVVATATVLGDKDEEVDSWLLLTKDPDNKNNDDDNNNNNNNKNNNNNNSNNGMYYGEVDEYFDLVGYNSYYDNRIENSQDQQYGMHEQQEQQQQQQQQQEMQKEFAEKEGSECVVPSQITMLSEQQHSGYGVVGADQAASMTAGVSAYTDSISNSISFSSMEVGIVPDSTVIDMPNSSILTPAGAINLFSGPSLQMSLHFSSMDREARVLRYREKKKARKFEKTIRYATRKAYAEARPRIKGRFAKRSDVEIEVDQMFSTAALSDGSYGTVPWF

SEQ ID NO: 343 - protein, 366 aa, Brassica napus
MFKQESNNIGSEENNTGPRACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 344 - protein, 366 aa, Brassica napus
MFKQESNNICNRENNRGARACDTCGSTICTVYCHADSAYLCNSCDAQVHSANRVASRHKRVRVCESCERAPAAFMCEADDVSLCTACDLEVHSANPLARRHQRVPVVPIIGNSCSSLATANHTTVTEPEKRVVLVQEDAKETASWLFPKNSDYHNNNNNQNNELLFSDDYLDLADYNSSMDYKFTSQYNQPRHKQDCIVPEKNYSGDRVVPLQLEETRGNLRNKQQNITYGSSGSQYNNNGSINHNAYNPSMETDFVPEQTAPDTTVSHPKTHKGKTAQLPEPLIQILSPMDREARVLRYREKKKRRKFEKTIRYASRKAYAERRPRINGRFAKMSETEVEDQEYNTMLMYCDTGYGIVPSFYGQK

SEQ ID NO: 345 - protein, 368 aa, Brassica napus
MFKQESNNNICNRENNRGARACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 346 - protein, 343 aa, Vitis vinifera
MALLYCRADSAKLCLSCDREVHSTNQLFTKHTRSRLCDVCDASPASILCSTDNLVLCQNCDWAKHGRSLSSAHDRRPLEGFSGQPSVTELLAFVGFEDLGKKSLFCGDESEFSDFLVWDTPAVVNLDDLIVSTACDHNFQAMGVPPLPKNRGAPCGQHKAEIIHQLRQLAKIELSFDFDHGDAKPPIGFQSHIPKQLIQKENECNSCDHEVEFVFPTYEASAFQWCSDGSEAANQVLPSVLLGSCADEKCLVPRKHSDIGGSVSHTNGSDEGKSECPVVTKTLPALPKVSVHELNSQERDSAISRYKEKKKTRRYEKHIRYESRKARAESRIRIKGRFAKMDH

SEQ ID NO: 347 - protein, 448 aa, Oryza sativa Japonica Group
MNYNFGGNVFDQEVGVGGEGGGGGEGSGCPWARPCDGCRAAPSVGYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNSSNNGMYFGEVDEYFDLVGYNSYYDNNNNDNSNSNSSNNDNDNDNDNNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISFSSMEAGIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDSSYGTVPWF

SEQ ID NO: 348 - protein, 501 aa, Oryza sativa Japonica Group
MNYNFGGNVFDQEVGVGGEGGGGGGEGSGCPWARPCDGCRAAPSVVYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNSSNNGMYFGEVDEYFDLVRYNSYYDNNNNDNSNSNSSNNDNDNDNDNNNNSNSSNNGMYFGEVDEYFDLVRYNSYYDNNNNDNSNSNSSNNDNDNDNDNNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISFSSMEAGIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDSSYGTVPWF

SEQ ID NO: 349 - protein, 481 aa, Oryza sativa Japonica Group
MSSTAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAFGQLLSRRLVVVPEAAAGSGGDSPEERKDEGEIVEEQEQLLYRVPIFDPALSEFCSPPPLEDAAAAVSCCNEDGAVENPTKPSMTTTTATTPPLQFFPDGQANFGPTDAELREFAADMEALLGRGLDDGNDEDSFCMETLGLIEPVDDDAGRVKVEADGDAGMTLAWCHELDTETSSGEMLDIDFDCGSPQAATTPDEKVGSSGPAAADDDAQLQQSNLALSLNYEAIIESWGTSPWTDGERPHVKLDDSWPRDYSVRATPCTPYASSHRILHNLAGTDDLLRRRAAVQGVWMAAAGVFGHGGEEQALTPRLGMDGGREARVSRYREKRRTRLFSKKIRYEVRKLNAEKRPRMKGRFVKRAAAAATAAVATACVA

SEQ ID NO: 350 - protein, 379 aa, Arabidopsis lyrata subsp. lyrata
MGYMCDFCDEQRSMVYCRSDAACLCLSCDRNVHSANALSKRHSRTLVCERCNAQPASVRCSDERVSLCQNCDWLGHDGKNSTTTTSNHKRQTINCYSGCPSSAELSSIWSFFMDLNISSAGESACEQGMGLMTIDEDSTGEKSGVLNVNVDQPETSSAAQGMDRSSVPENSSLAKELGVCEDDFNGNLITDEVDLALENYEELFGSAFNSSRYLFEHGGIGSLFEKDEAPEGSNKGNEMQQPAVNNNASADSFMTCRTEPIICYSSKPTHSNISFSGITGESNAGDFQDCGASSMKQLLREPQPWCHPTAQDIIASSHATTRNNAVMRYKEKKKARKFDKRVRYVSRKERADVRRRVKGRFVKSGEAYDYDPMSPTRSY

SEQ ID NO: 351 - protein, 330 aa, Arabidopsis lyrata subsp. lyrata
MEARCDYCETEKALIYCKSDLAKLCLNCDVNIHSANPLSQRHTRTLLCEKCFLQPTVIHCMNEKVSLCQGCQWTATNCTGLGHRLQNLNPYSGCPSPSDFAKIWSSILEPSVSNWVSPFPDTLLQELDDWNGSSTSVITQTQNLKDYSSFFSMESNLPKVIEEECSGLDLCEGINLDDAPLNFNASNDIIGCSSLDNTKCYQYEESFKEENNIGIPSLLLPALSGNVVPSMSISMSNITGENSATDYQDCGISPGFLIGDSPWESNVEVSFNPKSRDEAKKRYKQKKSKRMFGKQIRYASRKARADTRKRVKGRFVKSGETFEYDPSLVM

SEQ ID NO: 352 - protein, 360 aa, Arabidopsis lyrata subsp. lyrata
MASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYLSDIDGNGSREEEEEEAASWLLPNPKTTTTATAGMVAVTAAEEVPGDSPEMNTGQQYLFSDPDPYLDLDYGSVDPKVESLEQNSSGTDGVVPVENRTVRVPTVNENCYEMDFTGGSKGFAYGGYNCISHSVSSSSMEVGVVPDGGSVADVSYPYGGPATSGADPGSQRAVPLTSAEREARVMRYREKRKNRKFEKTIRYASRKAYAEMRPRIKGRFAKRTDTSESSDVVGHGGIFSGFGLVPTF

SEQ ID NO: 353 - protein, 371 aa, Arabidopsis lyrata subsp. lyrata
MLKQESNEIDSEENNRARACDTCRSNACTVYCHADSAYLCMSCDAQVHSANRVASRHKRVRVCESCERAPAAFLCEADDASLCIACDSEVHSANPLSRRHQRVPILPISGNSFSSMATHHQSETTMTDPEKRLVVDQEKGEEGDEDAKEVASWLFPNSDKNINNQNNGLLFSDEYLDLVDYNSSMDYKFTGQYHQHQQNCGVPQTSYGGDGVVPLQLEESRRHQCHNQQNFQFDIKYDSSGSHYNDNCSLNHNVYILSMETGVVPESTARDKTASPPRTPKKTTDQLPDPPIQMITQLSPMDREARVLRYREKKKTRKFEKTIRYASRKAYAEIRPRVNGRFAKRREIEAEDQVFNTMLMYDTGYGIVPSC

SEQ ID NO: 354 - protein, 348 aa, Arabidopsis lyrata subsp. lyrata
MMKVESNWGQACDTCRSAACTVYCRADSAYLCTSCDAQVHAANRLASRHERVRVCQSCERAPAAFFCKADAASLCTTCDSEIHSANPLARRHQRVPILPISENSYSSTATNHSCETTVTDPENRLVLGQGEEDEDEAEAASWLLPNSGKNNGNNNGFSIGDEFLDLVDYSSSDKQFTDQSNQYQLDCNVPQRSYEDGVVPLQVEVSKGHMNHEQQNFQLSITCGSPRAHRSSNGSLSHMVHVSSIDLGVVPESTNPRSPKAVTDQLPDPPAQMLSPRDREARVLRYREKKKMRKFEKTIRYASRKAYAEKRPRIKGRFAKRNEVDAEANEAFSTIITFDTGYGIVPSF

SEQ ID NO: 355 - protein, 400 aa, Arabidopsis lyrata subsp. lyrata
MGGSTRESVVACEFCGERTAVLFCRADTAKLCLPCDQHVHSANLLSRKHVRSQICDNCSKEPVAVRCFTDNLVLCQDCDWDVHGSCSSSATHERSAVEGFSGCPSVLELAAVWGIDLEGKKKEDEEDQLTKNFGMALDSWGSGSNSGQDLIVPYDVSIKKQSFSLGRSKKVVFKQLELLKRGFVGGDGGGEIMVPERINGGGSICQPSPMSAESQSHCGNAMQWNATNHSSTLPIIAIWDFNLGQSRNPEEPSPVETKGSTFTFNEVTHVKNDTRATNVKAFKETYQQDDSIRSTSTKGQETSKSNNIPAAIHSHKSSNDSSDLHCMEHIAMTSNRATRLVAATNADLERLAQNRDNAMQRYKEKKKTRRYDKTIRYETRKARAETRLRVKGRFVKATDP

SEQ ID NO: 356 - protein, 366 aa, Arabidopsis lyrata subsp. lyrata
MGYMCDFCGEQRSMVYCRSDAACLCLSCDRSVHSANALSKRHSRTLVCERCNAQPATVRCVEERVSLCQNCDWSGHNNNSSSSSTSPQQHKRQTISCYSGCPSSSELASIWSFCLDLAGQSICEQEMGMMNIDDDGPTDNKNCNEDKKDVFVSIPETSSAAKGKSSSAKDVGVCEDDFYGNLGMDEVDMALENYEELFGTAFNPSEELFGHGGIDSLFQKHQTKAPEGGNSVHPAGSNDSFMSSKTEPIICYTSKPAQSNISFSGVTGESSAGDFQECGASSSIQLSGEPPWYPPTSQENNACSHSVTRNNAVMRYKEKKKARKFDKRVRYASRKARADVRRRVKGRFVKAGEAYDYDPLTPTRSY

SEQ ID NO: 357 - protein, 377 aa, Arabidopsis lyrata subsp. lyrata
MEPKCDHCATSQAVIYCKSDLAKLCQNCDFHVHSANPLSHRHSRSLICQKCFSQPAVIRCLGEKVSYCQRCHWHASNCSDLGHRVQRLNPFSGCPSPTDFVKMWSSILEPSVSSLVSPFVGSLPLNDPNNTMFGMAKINELDGLIGSPYSMVPHSFNVTQNFSDQLSFFSVESKGYPDLVLKLEEGEEDLCEGLNFDNAPLNFDVGDDIIGCSLEEPIEPDHTVPNCLLIDKNNTSVTASNFTIDNTSASSPGQQMNINTGLPLPLSPVLFGQIHPSLNISNVTGESNAADYQDCGMPPGFITSEAPWESNLEVSCPQARTQAKLRYMEKKLKRSFGKQIRYASRKARADTRKRVKGRFVKAGDNYDYDPSSPTTNN

SEQ ID NO: 358 - protein, 347 aa, Arabidopsis lyrata subsp. lyrata
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAASETDADNDEDDREVASWLLPNPGKNSGNQNNGFLFGVEYLDLVDYSSSMDNQFEDHQYSHYQRSFGGDGVVPLQVEESTSHLQQSQHNFQLGINYGFSSGANYNNNFLKDLNHSASVSSMDISVVPESTASDITVQHPRTTKETTDQLAGPPTQVVQQLTPMEREARVLRYREKKKTRKFDKTIRYASRKAYAEIRPRIKGRFAKRIEIEAEAEEIFSTSLMSETGYGIVPSF

SEQ ID NO: 359 - protein, 391 aa, Arabidopsis lyrata subsp. lyrata
MVVDVERRAASVPGGKMVARGCDACMKRSRASWYCPADDAFLCQSCDSSIHSANHLAKRHERVRLQSSSWTETTEKTTSVWYEGFRRKARTPRNKGLASEKLLQMEANDPLVPDLGGEEEEVFFSFSSVEENEESLNCCVPVFDPFSDMVIDDINGFCLVPDEVINNTTNGEELGELEREVIDDEGFIGFLPLDMDLEDLTMDVERLLKEGQLCLGLKEPNDIGVIKEENNVGFEIDCKDLKRVKDEEEEEAKCENGRSKDSDGEASKDEDRKTSLFLSLDYEAVITAWDNHGSPWKTGIKSECLLGGNTCPSHAVGGFDELVSTVGSVTRQQVKDGGGSDGEREARVLRYKEKRRTRLFSKKIRYEVRKLNAEQRPRIKGRFVKRTSLLT

SEQ ID NO: 360 - protein, 412 aa, Arabidopsis lyrata subsp. lyrata
MMKSLASAVGGKTARACDSCVKRRARWYCAADDAFLCHACDGSVHSANPLARRHERVRLKSASSGKHRHASSSSPSHQSTWHQGFTRKARTPRGGKKSHTMVFHDLVPEMSTENQAESYEVEVEEQLIFEVPVMNPMVKEQCFHQSVETKVEFPMMPLSFKCSDEEDEDNAESCLNGLFPTDMELAQFTADVETLLGGGMEREFHSIEELGLGEVLKIEKEEVEEEEGVVTREVYDLDEAEETSPFEISFDYEYAHKTTYEEEEEDEKEDVMKNRMDVGVNEMSGRIKEENKEKALMLRLDYESVISTWNGQGIPWTDREPSEIDLDMVCCPTHSLGESGEAHHHNHFRGLGLHMGEAGDGGREARVSRYREKRRTRLFSKKIRYEVRKLNAEKRPRMKGRFVKRSSIGVAL

SEQ ID NO: 361 - protein, 419 aa, Arabidopsis lyrata subsp. lyrata
MKSLANAVGAKTARACDSCVKRRARWYCAADDAFLCQSCDSLVHSANPLARRHERVRLKTASPAVVKHSNHSSSSPPHEAATWHHGFTRKARTPRGSGKKNNSSIFHDLVPEISVEDQTDSYELEEQLICQVPVLDPLVAEQFLNDVVEPKIEFPMMRSGVMIEEEEDNAESCLNGFFPTDMELEEFAADVETLLGRGLDSESYPMEELGLSNSEMFKLEKDEIEEEVEERKAMNMEIFDDDRRDGDGTVPFELSFDYESSHKTSKEEVMKNVESSGECVVKVKEEEQKNVLLLRLNYDSVISTWGGQGPPWSSGVPPERDMDISGWPAVSMGENGGECTHKKQYVGGCLPSSGFGDGGREARVSRYREKRRTRLFSKKIRYEVRKLNAEKRPRMKGRFVKRASLAASAAAISPLGVNY

SEQ ID NO: 362 - protein, 326 aa, Arabidopsis lyrata subsp. lyrata
MIWENQTDVKQQRACELCKNKHAVWYCASDDAFLCHVCDESVHSANHVATKHERVCLRTNEISNYVLRGTTSNPVWHSGFRRKARTPRVRCEKKPQEKIDDERRIEDPRVPEIGGEVMFFIPEPNDDDMTSLVPEFEGFTEMGFFLNNHNGTEETTKQFNFEDEIDAKEDLCYNGEDEEEVKTDGAEACPEQYLMSCKKDYDNVITVSAKTEEIEDCYENKARQRNMLLKLNYENVIAAWDKQESPINQTEFNNTSNLQLVPPLQGIEEKRVSNRSEREARVWRYRDKRKNRLFEKKIRYEVRKVNADKRPRIKGRFVRRSLAMDS

SEQ ID NO: 363 - protein, 438 aa, Vitis vinifera
MADTCLAPHLGAEFAFTSVARNMESDACHSKGFSTTPTCLFRLPTVTSSPPFVHCAPETQTYAHSHSLTHMLKDEGCNADAAAGGGGGWARVCDTCRSAACTIYCRADSAYLCAGCDARIHAANRVASQHERVWVCESCERAPAAFVCKADAASLCATCDADIHSANPLARRHHRVPVLPIAGCLYGPPATDPGGTEDEDEAASWLLLNPVKNNNGSSNNQNNGLLFGGEVDEYLDLVEYNSCPENQFSDQYNQQQPPPHYSVPHKNYGGDRVVPVQCGEAKGQLHQQHQQQGFHLGMEYESSKAAYSYNPSISHSVSVSSMDVGVVPEATTMSDISISISHPRPPKGTIDLFSGPPIQMPTQLTPMDREARVLRYREKKKTRKFEKTIRYASRKAYAETRPRIKGRFAKRTDVEVEVDQMFSTTLMAESGYGIVPSF

SEQ ID NO: 364 - protein, 342 aa, Brassica rapa
MGYMCDFCGEQRSMVYCRSDAACLCLSCDRSVHSANALSKRHSRTLVCERCNSQPATVRCVEERVSLCQNCDWSSHNNNNNSSSSSNNHKRQTISCYSGCPSSSELASIWSFCLDLAGQSGCEQEMGMMNIDGDGQNNQNCNEEKKDVVAGSSSRPETSSAAPATSAFPKDVRVCEDDFYGNLGMDEVDLALENYEELFGTAFNTSGELFGQGGIDCLFQKHHQGAAPEGGNLVQPAESNDDSFMSSKTEPIICFTSKPAHSNISFSGVTGDSSAGDFQECGASSSMQLSGEPPWYPQTSQDNNASSHSVTRNNAVMRYKEKEKARKFDKTVRYASRKQELM

SEQ ID NO: 365 - protein, 484 aa, Malus x domestica
MVSPKSGGVEGVPCDFCSDQPAVLYCRADSAKLCLFCDQHVHSANLLSRKHVRSQICDNCSSEAVSVRCSTDNLVLCQECDWDAHGSCSVTAAHDRTPLEGFSGCPSALELASLLGLDLQDKNLPARPDPQLQNWDMGLPSVDPSWNGFGMQDLMVPIQNGVVDLTGDMKRQNSGGISGKQKQGIQKQLLELLKRDLGGGRGGGGSGSENLVPGTQTRNGWQEENGKGNGDVEGLASIDVRNENGGVGGVAARAASLETVLQQQTPFSTMLMMPEENRDGDMLWDSNPHGQTQIWDFNLGRLRDHEESGPLKVTYGSNVSGFMIKDFSELMKESSLTDTKMLRDIYQMNSPVGHDDIKFNITSNNPEGSLGPATSESNNVPIGQPLSGSVFGDDKGSGASNDISFMEQSFLMRGDSISMRTVGTKADMELLAQNRGNAMLRYKEKKKTRRYDKHIRYESRKARADTRKRVKGRFVKATTESPDG

SEQ ID NO: 366 - protein, 364 aa, Malus x domestica
MCEVCDQAPAAVTCKADAAALCVACDADIHSANPLARRHERVPVEPFYDSAESIIVKSTAAAPSSAGAAINYLVPNGDVLSKTKDVNNDPASNWLIPNPNFNSKLQMDIAPDITKSSGDLFFPEMDLLLELDYPNSIHTISGPGTDGVVPVQTDPIPPPSLKMNHNISGPADQNCFDMDFCSSKFSSSFSYPTQSLSQSVSSFSLDVGVVPDQNSLSDISYTFGRTACNGVSEPGDVSYSFGQKASNNVSEPGDISYPFGRKASNNVSEPGAPVSATPASQPATQLCGLNREARVLRYREKRKNRKFQKTIRYASRKAYAETRPRIKGRFAKRTKTETETFDLIYGSGSATFISDPQFGVVPTF

SEQ ID NO: 367 - protein, 393 aa, Malus x domestica
MLKEDQSNGTATANNWARVCDTCRAAACTVYCRADSAYLCSGCDATIHAANRVASRHERVWVCEACERAPAAFLCKADAASLCTACDADIHSANPLARRHQRVPILPISGCLYSSQATEQGEMGVAVSAGAETEDGFLSQEGDDTIYEEDEDEAASWLLLNPVKNNNNNNNTNTQNNGFFFGAEVDEYLDLVEYNTCADQNNQFTDHHQQHDQQQQQQYGVPYKNYGGDSVVPIHQHGEVGKAHQLQKQSFHQLGLEYESSKAAYSYNGSLSHSVSVSSMDVGVVPDSTMSDISISHPRTPKGTIDLFSGPTIQMPTQLSPMDREARVLRYREKKKTRKFEKTIRYASRKAYAETRPRIKGRFAKRTEMEVEVDQMFATSLMAENGYGIVPSF

SEQ ID NO: 368 - protein, 409 aa, Malus x domestica
MGYMCDYCQVQRSMVHCRSDAACLCLSCDRNVHSANALSRRHLRTLICERCNSQPALVRCTEERVSLCQNCDWMGHQASTSASGHKRQTLNCYSGCPSSAELSSIWSFVSDLPSNGESACEQEMGLMSIAENSTRSEWSQTESNTRQSASGADEVNPAHSMEKSGILVGSSSVPERSHARHVVGQLSGSVNASLPKLYSHGGKGTGLPEDDDLYDDLDMDEMELNLENYDELFGVSLNHSEELFKNGGIDSLFGAKNVSRDCQDAVAAEGSSFGLGNAPQPACSNAASADSVMSTKTDPVICFPAKQAHSNLSFSGITGESSAGDCQDCGASSTPWYPPCPESSMQSANRSNAVMRYKEKKKARKFEKRVRYASRKARADVRKRVKGRFIKAGEAYDYDPLNQARTRSY

SEQ ID NO: 369 - protein, 448 aa, Selaginella moellendorffii
MEKASSTSKSSSNLAATAMAIAGRALRPCDVCGRERAKWFCKADEAYLCENCDGSVHGANAVSLRHERFRMGPNGMLMKNVKRVSKFQLAEDISPTNSAAAVTAACAKDSHCPPRKKPRSSRSHSLGSNSSKESGKVKAEPKSPKEYAAEFQPCQESSHEVPIFDPLLEDFAASDDNSLGCTVPCATPPDEDDEEMCFTVPDDCDLDGFLDSEADLGVMDGIISGTIEMDGIADLGDVLGESECKTFTHDSFGIDFPAIFHSPSPNSDGSVADAFDSADAVKVKTEEAEELDKIKLEVDEMLGFAFSSASTVKEEEVEKKITLKLDYEDVLNAWSDRGPFWTEGPRPQTVPDDSLFDPASTLDYGLVPDFCMESTEVEAVGQVPVVNFGEDRLTPQGGREARVMRYREKRRTRLFSKKIRYEVRKLNAERRPRLKGRFVKRTNSTPHA

SEQ ID NO: 370 - protein, 287 aa, Selaginella moellendorffii
MAKRPNCDVCEMQRASLYCEADEAYLCHECDASVHGANTLASRHKRISFKQEQEEEEEEENLEENDGVCPAHNFADSSFSLSRPSTVDYPLGGVRIGDVTYARVSSHTGSGGASLIAPRRKEDEELHQVPRFVPVAQELPSLEPFRFHALASNGRASPVRSTRFMSLLEGEATDADENHGAPDEDGAQENQELGVVPDLVSPRTVEPAAAKPVAALPKGGPRLDKEREARVNRYREKRRTRMFSKKIRYEVRKIYAENRPRLKGRFVRRTNEIESLQCLWSEDQVRN

SEQ ID NO: 371 - protein, 448 aa, Selaginella moellendorffii
MEKASSTSKSSSNLAATAMAIAGRALRPCDVCGRERAKWFCKADEAYLCENCDGSVHGANAVSLRHERFRMGPNGMLMKNVKRVSKFQLAEDISPTNSAAAVTAACAKDSHCPPRKKPRSSRSHSLGSNSSKESGKVKAEPKSPKEYAAEFQPCQESSHEVPIFDPLLEDFAASDDNSLGCTVPCATPPDEDDEEMCFTVPDDCDLDGFLDSEADLGVMDGIISGTIEMDGIADLGDVLGESECKTFTHDSFGIDFPEIFHSPSPNSDVSDADAFDSADAVKVKTEEVEELDKIKLEVDEMLGFAFSSASTVKEEEVEKKITLKLDYEDVLNAWSDRGPFWTEGPRPQTVPDDSLFDPASTLDYGLVPDFCMESTEVEAVGQVPVVNFGEDRLTPRGGREARVMRYREKRRTRLFSKKIRYEVRKLNAERRPRLKGRFVKRTNSTPHA

SEQ ID NO: 372 - protein, 452 aa, Selaginella moellendorffii
MERPCDFCGDERATVYCKADAALLCLSCDRNVHDANALSRRHSRTLVCDMCVVQPAVVRCGAESKAFCQACDGKRHAEYRAMHHKRRAIVSYTGCPSSAELARLWYCDVSDEPGGNGSGNGSGKGSTSKCLETFQGWVPASSQSQQQLHHPSTPQSREKKIFQQLMILQNRPPQQGLGHQQREKAITQAQTLMPPPPPRPSTSSSNGVAEIQYQTAQLGLHSPSSKPESGEIFPQQGENAWKAASPDQQLWNNAQDMGIDDICKALTADDVNVFDNYEDLFLSAQDAAGTPFQDIGIACPSMAPAMSSKSMQNGCSSMDTANSLQSDASESACRGPFHPAAAAGNVQFSPRPACSSGVSGDSSGTEYADCASVFYSAGELWSSTSSDPAAASEARGNAMLRYKEKRKTRKYEKRIRYESRKTRADTRRRIKGRFVKAGQVYDYDPLSTTRSY

SEQ ID NO: 373 - protein, 363 aa, Selaginella moellendorffii
MTKPCDACQSGNAVIYCRADAAFLCCSCDNKVHCANKLASRHERVLVCEVCEHAPAAVTCKADAAALCVTCDSDIHSANPLARRHERVPITPFVDSSDGGAAPPPAPPILHDTGNANHDDEEESSAAEAASWLLPQPNNLAKSDGEKLGGGVESTDFYSTLKPSAPPPLRIEKLLLKSQAAANFDLFSDEDSYLDMDFLGALHSVTDSLVPIHTTGGALHSSSPVGSNADSYDLDVHDKSPPHAYCPGLSLSASSIDVGVVPDASLSDISTPQSRPTSSSVFGSGEAQAAAAPLHHATPLEPIAREARVLRYREKRKNRKFEKTIRYASRKAYAETRPRIKGRFAKRGEMDSYDASFGVVPSF

SEQ ID NO: 374 - protein, 453 aa, Selaginella moellendorffii
MERPCDFCGDERATVYCKADAALLCLSCDRNVHEANALSRRHSRTLVCDMCVVQPAVVRCGAESKAFCQACDGKRHAEYRAMHHKRRAIVSYTGCPSSAELARLWYCDVSDEPGSGSGSGNGSGKGSTSKSLETLQGWLPASSQSQQQLHHPSTPQSREKKIFQQLMILQSRPPQQALGHQQREKAITQAQTLMPPPPPRPSTSSSSGVAEIQNQTAQLGLHSPSSKPESGEIFPQQGENAWKAASPDQQLWNNAQDMGIDDICKALTADDVNVFDNYEDLFLSAQDAAGTPFQDIGIACPSMAPAMSSKSMQNGCSSMDTANSLQSDASESACRGPFHPAAAAGNVQFSPRPACSSGVSGDSSGTEYADCASVFYAAGELWSSTSSDPAAASEARGNAMLRYKEKRKTRKYEKRIRYESRKTRADTRRRIKGRFVKAGQVYDYDPLSTTRSY

SEQ ID NO: 375 - protein, 405 aa, Volvox carteri f. nagariensis
MACVVCAAQASVYCENDKALLCKDCDVRIHMSNAVAARHVRRIPCEGGCSKGASLFCRCDNAYMCEACHCANPLAATHETEPTAPLPLMEQENAVAEQPHATGPCESVAQSAASPVAWFVDDEKPSLGSFEEPIMLSPAGSEAVVPVMSAPADDFTFTEPATFKEIKDKLEFESLEFDNSWMELNFDFTDILSDGPSDVGLVPTFDLEGVDPVADATVPSVAEEVVVAESDAATEIHRKRTAEPSDEEPAAKLPAISEAATTALGLHAAFQMTQPASLFFQSAVAQPSLLPPMVPPAVISPLATTAAAPPLQPPPTAVQSKSSAAYNTALAAGANLTREQRVARYREKRKNRKFEKTIRYASRKAYAEIRPRIKGRFAKKEEIEAWKAAHGGEDAVVPEILDGEF

SEQ ID NO: 376 - protein, 402 aa, Arabidopsis thaliana
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 377 - protein, 417 aa, Arabidopsis thaliana
MMKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 378 - protein, 406 aa, Arabidopsis thaliana
MDPTWIDSLTRSCEANSNTNHKRKRERETLKHREKKKKRFRERKMASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFTYGGGYNCISHSVSSSSMEVGVVPDGGSVADVSYPYGGPATSGADPGTQRAVPLTSAEREARVMRYREKRKNRKFEKTIRYASRKAYAEMRPRIKGRFAKRTDTNESNDVVGHGGIFSGFGLVPTF

SEQ ID NO: 379 - protein, 326 aa, Arabidopsis thaliana
MTSHQNIKISEKIMISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 380 - protein, 385 aa, Helianthus annuus
MLDHTGTLCLKTSTTWARVCDTCRSAPCTIYCRPDAAYLCTACDARIHAANKLQSSQHERVWVCEACEQAPAAFICKADAASLCTTCDADIHSANPLARRHHRVPVMPIPGALYGPQGAGPDPRAVMGLGVGVDSQSGFLSNDGGGDEEDESEAASWLLFDGPVVVNKNSQSQSGGGGKDSGFLFSGEGGEEDEYLEFMEFGSDVQAQCYANKVNDQKMSYADADSVVPVQKNHEFQNHKFQLGVDYEGAAAGATGGYGYPQLTHSVSMSSMEVGVVPDSTITEASFSHPRPSKGTIDLFSNPPVQVATQLTPMDREARVLRYREKKKTRKFEKTIRYASRKAYAETRPRIKGRFAKRTNADVDVDQMFPTNHMLEGGYGIVPSF

SEQ ID NO: 381 - protein, 385 aa, Helianthus annuus
  misc_feature (246)..(246): Xaa can be any naturally occurring amino acid
  misc_feature (337)..(337): Xaa can be any naturally occurring amino acid
  misc_feature (361)..(361): Xaa can be any naturally occurring amino acid
MLDHTGTLCLKTSTTWARVCDTCRSAPCTIYCRPDAAYLCTACDARIHAANKLQSSQHERVWVCEACEQAPAAFICKADAASLCTTCDADIHSANPLARRHHRVPVMPIPGALYGPQGAGPDPRAVMGLGVGVDSQSGFLSNDGGGDEEDESEAASWLLFDGPVVVNKNSQSQSGGGGKDSGFLFSGEGGEEDEYLEFMEFGSDVQAQCYANKVNDQKMSYADADSVVPVQKNHEFQNHKFQLGVXYEGAAAGATGGYGYPQLTHSVSMSSMEVGVVPDSTITEASLSHSRPSKGTIDLFSNPPVQVATQLTPMDREARVLRYREKKKTRKFEKTIXYASRKAYAETRPRIKGRFAKRTNXDVDVDQMFPTNHMLEGGYGIVPSF

SEQ ID NO: 382 - protein, 388 aa, Helianthus annuus
MLNEDLTSTLCLKNSTTRARLCDTCHLLPGTIFCEADLAYLCTACDLHVHAANKLSSRHKRVRVCDACEQAPAAFICKADAASLCTTCDAVIHSANPLSRRHHRVPVMPILGSSVYNNNNNNEPWSVIGLGFQPQDSADQATLDHHNHHQDEDEAASWLIFHDSPPKNNGQGQSQTNEFVSNGDEYLELVDYNSCQDTPFSDDLKFDDDNKYMHDGINNNIQQQQRYGGCDADSLVPGQKYHQLQHQHNFQNQKFQLGMDYETSNGGYGYSASLGDSVSMSSMEVGIAVDSTITEASIDLFSNPSIQMPTQLTPIDREARVLRYREKKKTRKFEKTIRYASRKAYAETRPRIQGRFAKRTNLDIDIEVDQMFSTSLITQDGSCTFPSF

SEQ ID NO: 383 - protein, 386 aa, Helianthus annuus
  misc_feature (213)..(213): Xaa can be any naturally occurring amino acid
MLNEDLTSTLCLKNSTTRARLCDTCHLLPGTIFCEADLAYLCTACDLHVHAANKLSSRHKRVRVCDACEQAPAAFICKADAASLCTTCDAVIHSANPLSRRHHRVPVMPILGSSVYNNNNNNNNEPWSVIGLGFQPQDSADQATLDHHNHHQDEDEAASWLIFHDSPPKNNGHGQSQTNEFVSNGDEYLELVDYNSCQDTPFSDDLKFDDDNXYIQQQQQQQQRYGGCDADSLVPGQKYHQLQHQHNFQNQKFQLGMDYETSNGGYGYSASLGDSVSMSSMEVGIAVDSTITEASIDLFSNPSIQMPTQLTPIDREARVLRYREKKKTRKFEKTIRYASRKAYAETRPRIQGRFAKRTNLDIDIEVDQMFSTSLITQDGSCTFPSF

SEQ ID NO: 384 - protein, 337 aa, Brassica napus
MLKQEGNWAQTCDTCRSAACTVYCRADSAYLCTSCDAQIHAANRLASRHERVRVCQSCERAPAAFFCKADAASLYTACDSQIHSANPLARRHQRVPILPISGSMVTNRSSETTEAEDIVVVGQEEEDEAEAASWLLPTSVKNCGDNNNNNNNSQDNRFSVGEEYLDLVDYSKYQQDYNVPQRRSYVADGVVPLQVEVSKSLSHMHHEQHNFQFGFTNVSSEASPIHMVSLVPESTLSETTVSNPRSPKAATEELPEAPVQMLSPMERKARVMRYREKKKTRKFEKTIRYASRKEYAEKRPRIKGRFAKRNEVDAEEADKAFSSMVMFDTGYGIVPSF

SEQ ID NO: 385 - protein, 369 aa, Triticum aestivum
MFMNCNFNSNLLENEAGRISFPWARPCDGCHAAPSAVYCCADAAYLCASCDTQVHSANRVASRHERVRVCETCESAPAVLACHADAAALCTACDAQVHSANPIAQRHQRVPVLPLPAVAIPAASGFAEAEASVTAHGDKEEGEEVDSWRLRRNSDDNNCANKIDRYYNLVGYNMYYNNITCDPRPEEQYRMQEQRVQNRYIEKQGCECVVPPQVVMASEQQESDYGTRGAGQAASVTAITSTYTASISNDISFSSMEVGIIPDNTRPDISNSNILTGSEAMELSGHSLQMPVHFSSMDREARVLRYKEKKQTRKFQKTIRYATRKAYAEARPRIKGRFAKRSDIEHEEDHMLSPPALPDTSSYNTVPWF

SEQ ID NO: 386 - protein, 370 aa, Triticum aestivum
MFMNCNFNSNLLEKEAGRTSFPWARPCDGCHAAPSAVYCCADAAYLCASCDTQVHSANRVASRHERVRVCETCESAPAVLACHADAAALCTACDAQVHSANPIAQRHQRVPVLPLPAVALPAASGFVEAEASVTAHGDKEEGEEVDSWLLRRNSDDNNCANKIDRYFNLVGYNMYYDNITCDPRPEEQYRMQEQQHVQNRYIEKEGCECVVPPQVVMASEQQESDYGTIGAGQAASVTAMTSTYTASISNDISFSSMEVGIVPDNTRPDISNSNILTSSEAMELSGHSLQMPVHFNSMDREARVLRYKEKKQTRKFQKTIRYATRKAYAEARPRIKGRFAKRSDIEHEEDHMLSPPALQDTSSYNTAPWF

SEQ ID NO: 387 - protein, 369 aa, Triticum aestivum
MFMNCNFNSNLLENEAGRISFPWARPCDGCHAAPSTVYCCADAAYLCASCDTQVHSANRVASRHERVRVCETCESAPAVLACHADAAALCTACDAQVHSANPIAQRHQRVPVLPLPAVAIPAASGFAEAEASVTAHGDKEEGEEVDSWLLRRNSDDNNCANKIDRYYNLVGYNMYYDNITCDPRPEEQYRMQEQHVQNRYIEKEGCECVVPPQVVMASEQQESDYGTIGAGQAASVTAMTSTYTASISNDISFSSMEVGIVPDNSRPDISNSNILTSSEAMELSGHSLQMPVHFSSMDREARVLRYKEKKQTRKFQKTIRYATRKAYAEARPRIKGRFAKRSDIEHEEDHMLSPPALPDTSSYNTVPWF

SEQ ID NO: 388 - protein, 321 aa, Brassica rapa
MLKEESNESGGTRACDTCRSAACTIYREADSTYLCTTCDARVHAAKRVRVCDSCESAPAAFFCKADAAPLCTACDAEIHSANPLARRHQRVPITSNSCGSMATDGDNNVMMVSEEKEDADEVASWLMLNPGKNNQNNGFLFGVEYLDLVDYSSSIDNQFEDQYNHYQRSFGGGEDGVVPLQLEESTSHMQQSQHNFHLGVNYGFSTEPHYSYISVVPESTSSDTTVQHAKETMDQVSGPPTQMVQQLTPADREARVLRYREKKKRRKFEKTIRYASRKAYAEVRPRIKGRFAKRIDMEADAEQLFSTSLMSNTSYGIVPSF

SEQ ID NO: 389 - protein, 422 aa, Populus deltoides
MPRFTSLILSSPLVFFLQVSLILATNAHSLSYIAKDSIIEIGIGREREEVMLKEESGGSGGVVNNWARVCDTCRAAACTVYCRADSAYLCAGCDARVHAANRVASRHERVRVCEACERAPAALLCKADAASLCTACDADIHSANPLARRHQRVPILPISGYLYGTQVGPAAGETEDQFMTQEGEETIGEEDEDEAASWLLLNPAKNSNNQNNNGFLFGGEVDEYLDIVEYNSCAENQYSDQYNQQHYSVPPKSCGGDSVVPIQYGEGKDHQQQQQQQYHNFQLGLEYEPAKAAYSYDGSVSQGVSMSSMDVGVVPESAMSEISISHQSASRGTIDLFSSPPIQMPSQLSPMEREARVLRYREKKKARKFEKTIRYASRKAYAETRPRIKGRFAKRTDVDVEVDQMFSSTLMAETAYGIVPSF

SEQ ID NO: 390 - protein, 372 aa, Populus deltoides
MLKQESSGSGGGDNRARLCDTCRAAACTVYCRADSAYLCAGCDARVHAANRVASRHERVWVCESCERAPAALLCKADAASLCTACDADIHSANPLARRHQRVPILPISGCLHGSQVGPAAGETEDRFTTQEGEETISEEEEEEEDEAASWLLLNPVKNSKNQNNNGFLFEGEVDEYLDLVEYNSCTENQCSDQYNQQHYCVPPKSYGGDRVVPIQYGEGKDHQQQRQYHNFQLGLEYEPSKAAYSYNGLISQSVSMSSMDVGVVPESTMSEISISQHRTPKRTIELFSSTAIQMPSQLSPMDREARVLRYREKKKTRKFEKTIRYASRKAYAETRPRVKGRFAKRKDVEVEDDRTFSSTLMAGTGCGIVPSF

SEQ ID NO: 391 - protein, 401 aa, Arabidopsis thaliana
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 392 - protein, 391 aa, Solanum lycopersicum
MLKKENSNNWARVCDSCHSATCTVYCRADSAYLCAGCDARIHTASLMASRHERVWVCEACERAPAAFLCKADAASLCASCDADIHSANPLARRHHRVPIMPIPGTIYGPPAVHTITGGSMMIGGTTGEGTEDDGFLSLNQDADDTTIDEEDEDEAASWLLLNPPVKNNNKNNNYGMLFGGEVVDDYLDLAEYGGDSQFNDQYSVNQQQQHYSVPQKSYVEDSVVPVQNGQRKSLILYQTPQQQQSHHLNFQLGMEYDNSNTGYGYPASLSHSVSISSMDVSVVPESAQSETSNSHPRPPKGTIDLFSGPPIQIPPQLTPMDREARVLRYREKKKNRKFEKTIRYASRKAYAETRPRIKGRFAKRTDVEAEVDQMFSTQLMTDSNYGIVPSF

SEQ ID NO: 393 - protein, 438 aa, Pinus radiata
MVLENFGGVGAREASCRIRHELRGIGGWRMSMPKLCDVCQVSSSVIYCRAHTAQLCLVCDAKIHGGSKASLCHERVWVCEVCEQAPAVVTCKADAAALCVACDTDIHSANPLASRHERAPVIPFYECPNMPTNNTVTHANNDNLDCNVLLNEDGGGDDPLKHDYVDDDYGDYDDDENDQNNLLNNQEDNNDAEICCAEEAATASWLIPEANRNNLTIINGGNSEGEDKMVKDKLKFKAYMQSMDFLQDVDNYADLEYLGTTTITTPINPTANMGADSMVPVHTPEVIEHSSTKVSIDTAGSMDVDAASKCNHVYRTTSLNHCVSSSPIDVGIVPDSNITSDISTPYHDPRGVFEIPPRVVHPGGQGEVMGREARVLRYREKRKNRRFEKTIRYASRKAYAETRPRIKGRFAKRTEVEVEQIYSSSLLPDQGYGVVPSY

SEQ ID NO: 394 - protein, 452 aa, Oryza sativa Japonica Group
MSCSSEKAAGAVGGKAARACDSCLRRRARWYCAADDAFLCQGCDTSVHSANPLARRHERLRLRVSSPPPLTARASVEEEAAAAVGTTTTTTSKREGGVTPAWSKRKARTRRPQVKSVGQLLSRRLVVPEMAVESSDERKADEDGAHEELEGQLLYRVPVFDPSLAEFCSPPPIDDAAAASSSCFKEDAADGAVEDAKYPAAAASSPVQQLPDSFVNFEPTDAELREFAADMEALLGQGLDDSNELQDSFYMETLGLITPPVEESGRVKMELDGGVASNSRVSLPSCRAHPKPEDVESADVLDIDFNCTSPDEQKSSASNGAAADSQFFHRSLDLRLNYEAIIESWGNSPWTDGRPPHGQLDDFWPNDHHYSGLWAAGGGGHGAEVGMMTVRPRMDGPGREARVTRYREKRRTRLFSKKIRYEVRKLNAEKRPRMKGRFVKRPSAAAAPCAVT

SEQ ID NO: 395 - protein, 362 aa, Arabidopsis thaliana
MASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFTYGGGYNCISHSVSSSSMEVGVVPDGGSVADVSYPYGGPATSGADPGTQRAVPLTSAEREARVMRYREKRKNRKFEKTIRYASRKAYAEMRPRIKGRFAKRTDTNESNDVVGHGGIFSGFGLVPTF

SEQ ID NO: 396 - protein, 405 aa, Pisum sativum
MLEQKFLTTTSATVRSAVTWPRTCDTCRSAPCAVFCRADSAYLCAGCDARIHAANRVASRHERVWVCEACERAPAAFLCKADAASLCSSCDADIHSANPLASRHQRVPILPISGYLYGPPTTLLGADDEGFVRGGGDAEEEEDEGADMEDENEAASWLLLNPLKNNHHNINNHNNNNNSNDHNQEGNNNGFLFSGEVDEYLDLVDCNSCGGGENTFTTNNTHDHDYSRDQQQQRQDHYGVPQKNYVGDSVVPVQQQHLQNFQLGLEFESSKAGFSYNGASISQSVSVSSMDVGVVPESTMRDATTMSYSRPSKGTIDLFSAPPIQMTSHFSPMDREARVLRYLEKKKTRKFEKTIRYASRKAYAETRPRIKGRFAKRTDVEAEVDQMFSTTLITEVGYGIVPSFV

SEQ ID NO: 397 - protein, 368 aa, Physcomitrella patens
MPKSCDACQASSAVVYCRADAAYLCLGCDGKVHGANKLASRHERLWMCEVCEVAAAVVTCKADAASLCVSCDTDIHSANPLAQRHERVPVQPLFDCVSQFRGTHFSVLAPKNECNNNLLKGDEDPAVAEAVSWLLPHPKTLSSAILRGIAAADEAPAFPFRERPFSPKLKKLKVEQAADIYSDVDPFLVLDGGNGTGFQPDSLVPVHIPEGPDDSPSLANSTAPSSAINFRASQKSGCSYGTSTLTHSMSCSSVDAAVVPDSSLSDISTPYSKALDSQDSQDLSGALVPHQASKPIDTVDREARVMRCKEKRQKRKFEKTIRYASRKAYAESRPRIKGRFTKRTDSDVEQMFSSCTADSGFGVVPSSC

SEQ ID NO: 398 - protein, 407 aa, Oryza sativa Indica Group
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSDNNNNNNNNNDNDNKDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 399 - protein, 319 aa, Arabidopsis thaliana
MFCAEIMISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 400 - protein, 348 aa, Glycine max
MLDGEATMGTWARMCDTCRSAPSSVFCRAHTAFLCATCDARLHASLTWHERVWVCEACERAPAAFLCKADAASLCASCDADIHAANPLASRHHRVPILPIAAAPGNNDNDNVDDADLDDDDETASWLLLNPVKSASVPNNNNTNNGFSYNGEVDEYLDLVDDCDNHHFASVATTTDHYSHQHQHFGVVSHKSYAGDSVVPVQHHQHFQLGLEFDNSKAAFSYNASVNQSVSVSSMDIGVVPESPMRDVSIGHTRTPKGTIDLFSGPPIQVPSHFSPMDREARVLRYREKKKTRKFEKTIRYASRKAYAETRPRIKGRFAKRTDVEAEVDQMFSTTLITEVGYGIVPSF

SEQ ID NO: 401 - protein, 328 aa, Glycine max
MLEGQATTPTWPRMCDTCRSVPSTVFCRSHTAFLCATCDTRLHVSLTWHERVWVCEACERAPAAFLCKADAASLCASCDADIHAANPLASRHHRVPILPIAAANNNNNDDDDVADVDDEDETASWLLLNPIKSATVPNTNNNNNNNGFLYNAAATTDHYAQHQHFAGVSQKSYAGDSVVPVQQHQHFQLGLDFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 402 - protein, 352 aa, Glycine max
MLEGQATTPTWPRMCDTCRSVPSTVFCRSHTAFLCATCDTRLHVSLTWHERVWVCEACERAPAAFLCKADAASLCASCDADIHAANPLASRHHRVPILPIAAANNNNNDDDDVADVDDEDETASWLLLNPIKSATVPNTNNNNNNNGFLYNGEVDEYLDLVDNCNSCGDNNHFASAAATTDHYAQHQHFAGVSQKSYAGDSVVPVQQHQHFQLGLDFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 403 - protein, 381 aa, Cleome spinosa
MLKEERTSGGETGENNWARICDTCRSAACTVYCRADSAYLCTSCDARVHAANHVASRHERVWVCESCERAPAAFLCKADAASLCAACDAEIHSANPLARRHHRVPILPISGSMSGPMANHHPSETAMTDTENDMVVGREEAEDEDEDDEEAASWLLLNPGKNSGNNNNQNNGFFFDGEADEYLDLVEYNSSMENQFSDQYSQYHQDCGVPQKSFGGDGVVPLQVEESRGQLHHEQQSFQLAITYGSPGALYGSYNGSMNHSVSMSSMDIVVVPESTASDMAVVSQLRAPKGTTDLLIGPPIQMMPQLSPMDREARVLRYREKKKTRKFEKTIRYASRKAYAETRPRIKGRFAKRTDIEAEVDQAFSTTLMQESGYGIVPSF

SEQ ID NO: 404 - protein, 317 aa, Medicago sativa
MATKLCDSCKSSKATLFCRSDSAFLCLTCDSNIHAANKLASRHHRVTLCQVCEQAPAHVTCKADAAALCISCDHDIHSANPLARRHERVPLTTFHHHNNNSQQQSFFSENDHDATNEEAGAASWLLQTPSNPKFPDLNYSHYSYPEIDDFVTVNAKTDTPEQNSPGTTADGVVPVQSQSKTTTEHQHEHYSDINIDFSNSKPFTYNFNHTVSSPSMEVGVVPDGNVMTEISYCGYQTTATETAPMTVAVPMTAVEREARVSRYREKRKNRKFEKTIRYASRKAYAETRPRIKGRFAKRSDLNMNLIAEDEYGVVPSC

SEQ ID NO: 405 - protein, 332 aa, Oryza sativa Japonica Group
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFPFSQAAADAAAAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGSAAPPMVVVVASKGKEREARLMRYREKRKNRRFDKTIRYASRKAYAETRPRIKGRFAKRTADADDDDEAPCSPAFSALAASDGVVPSF

SEQ ID NO: 406 - protein, 333 aa, Oryza sativa Japonica Group
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADSDPYLDLDFARSMDDIKAIGVQNGPPELDITGGKLFYSDHSMNHSVSSSEAAVVPDAAAGGGAPMPVVSRGREREARLMRYREKRKSRRFEKTIRYASRKAYAETRPRIKGRFAKRTKGGAGADADADADADGEDEEMYSSAAAAVAALMAPGGSDADYGVDGVVPTF

SEQ ID NO: 407 - protein, 331 aa, Oryza sativa Indica Group
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADSDPYLDLDFARSMDDIKAIGVQNGPPELDITGGKLFYSDHSMNHSVSSSEAAVVPDAAAGGGAPMPVVSRGREREARLMRYREKRKSRRFEKTIRYASRKAYAETRPRIKGRFAKRTKGGAGADADADADGEDEEMYSSAAAAVAALMAPGGSDADYGVDGVVPTF

SEQ ID NO: 408 - protein, 384 aa, Picea sitchensis
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDHDDDDEIYAAEAASWLLPNPKSSAEGTKNCDDGGSCFGVDAGPPVNKAAGGYFSVVDLFPDVDPYLDLDYASPLEATGGTDSVVPVQSNVSSQDGAVSTPSDCFDTEKVTYSYTTTTSLSHSVSSSSLDVGVVPDATLSDMPRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 409 - protein, 350 aa, Populus trichocarpa x Populus deltoides
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGAAVNLLEDRYFDEVDGGRGDVSREEAEAESWLLPNPGGGTAKGVDSMDLNTGQYVFGSEMDPYLDLDPYVDPKVEVQEQNSSGTTDGVVPVQSNKLGFQAPALVNDNCCYELDFSTGSKSFGGGYGYNSLSHSVSSSSLDVGVVPDGSGSTLTDISNPYCSRSVSNGMESANQTVQLSAVDREARVLRYREKRKNRKFEKTIRYASRKAYAETRPRIKGRFAKRTDTEVEVDRSSLYGFGVVPSF

SEQ ID NO: 410 - protein, 332 aa, Oryza sativa Indica Group
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFTFSQAAADAAGAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGAAAPPMVVVVASKGKEREARLMRYREKRKNRRFDKTIRYASRKAYAETRPRIKGRFAKRTADADDDDEAPCSPAFSALAASDGVVPSF

SEQ ID NO: 411 - protein, 384 aa, Picea abies
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDDDEDDEIYAAEAASWLLPNPKSSAEGAKNCDDGGSCFGVDAGPPVNKAAGGYFSVVDLFPDVDPYLDLDYASPLEATGGTDSVVPVQSNVSSQDGAVSTPSDCFDTEKATYSYTTTTSLSHSVSSSSLDVGVVPDATLSDMSRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 412 - protein, 294 aa, Arabidopsis thaliana
MASSSRLCDSCKSTAATLFCRADAAFLCGDCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYGGFGVVPSF

SEQ ID NO: 413 - protein, 362 aa, Chenopodium rubrum
MMKKEVPGGDNNSWARVCDTCRSAPCTVYCKEDSAFLCTSCDARIHAVNQMASRHERVWVCEACEREPAAFLCKADAASLCATCDADIHSANPLARRHHRVPIMPVGCVYGPSDGRMSEDGFLDLPDRDDQTTDHEGDEDEAASWLLLNPGKNSNNQTTNGFLTGGGEVDEYLDLFEYNSGADNQFCEQYNQQQEFSVPEKNCGGDSVVPVQCREVKDHQIQYQNFLFGMECETKSEYTYNTSISHSVSVSSLDVGVVPESTMSDMSVSHSRPPKGTIDLFSSTPMQVPTQLSPLDREARVMRYREKKKNRKFEKTIRYASRKAYAETRPRIKGRFAKRTDVEAERTNSLMSDGGYGIVPSF

SEQ ID NO: 414 - protein, 336 aa, Chenopodium rubrum
MMKKEVPGGDNNSWARVCDTCRSAPCTVYCKEDSAFLCTSCDARIHAVNQVASRHERVWVCEACEREPAAFLCKADAASLCATCDADIHSANPLARRHHRVPIMPVGCVYGPSDGRMSEEGFLDLPDGDDQTTDHEGDEDEAASWLLLNPGADNQFCEQYSQQQEFSVPEKNCGGDSVVPVQCREVKDHQIQYQKFLFGMECETKSEYNYNTSISHSVSVSSLDVGVVPESTMSDMSVSHSRPPKGTIDLFSSPPMQVPTQLSPLDREARVMRYREKKKNRKFEKTIRYASRKAYAETRPRIKGRFAKRTDVEAEMDQMFTNSLMSDGGYGIVPSF

SEQ ID NO: 415 - protein, 355 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 416 - protein, 348 aa, Beta vulgaris subsp. vulgaris
MGGGLMAAKLCDSCKSATATIFCRADTAYLCISCDAKIHAANKLASRHARVWVCEVCEHAPATVTCKADAAHLCATCDRDIHSANPLARRHERVPLTPFYDPLSPPNTTNNNNDDSDSSATAAAAAKSAAINKLFGDEYYSDADEAEAASWLLPNPNKTDEPKSIDYLFSSSGNDGDDIDPYLDLDFGAEAKPDPDLSSDGVVPDPDQKGVHHHHLTTLQHPAASMFSLSSYHHHHHHHHVSNNNGHFDGFENSSAACKPFALSSYHTQPSLSHSVSSSSLDFGVVPDASNITDVASTGFDKQQQMKIIGMDREARVLRYREKRKNRKFEKTIRYASRKAYAETRPRI

SEQ ID NO: 417 - protein, 340 aa, Malus x domestica
MALKLCDSCKSATGTLFCRADSAFLCVNCDSKIHAANKLASRHARVWLCEVCEQAPAHVTCKADDAALCVTCDRDIHSANPLSRRHERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 418 - protein, 339 aa, Brassica nigra
MLKQKSNNIDGEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMETHHQTETTEAEPEKRLVIHQEEDEARETASWLLPKDKNSNQNNELLLSDEYLDLADYNSNMDNKFTGQYSHHQQEGDVPQTNYVGDRVVPIQIQESNGSLRHKQQNMTYGSSDINSGSINHNNGYDTSMETDFVPEPTTPDTADGYTTDGKIDQPPEPPVKMIIQLTPMDREARVLRYREKRKTRKFEKTIRYASRKAYAERRPRINGRFAKMGETEDYDVD

SEQ ID NO: 419 - protein, 338 aa, Brassica nigra
MLKQKSNNIDSEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMDTHHQTETTEAEPEKRLVIHQEEDEARETASWLLPKDKNSNQNNELLLSDEYLDLADYNSNMDNKFTGQYNHHQQEGDVPQTNYVGDRVVPIQIQESNGNLRHKQQNMTYSSDINSGSINHNNGYDTSMETDFVPEPTTLDTADGDTTDGKIDQPPEPPVKMIIQLSPMDREARVLRYREKRKTRKFEKTIRYASRKAYAERRPRINGRFAKIGKTEDYDVD

SEQ ID NO: 420 - protein, 339 aa, Brassica nigra
MLKQKSNNIDGEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMETHHQTETTEAEPEKRLVIHQEEDEARETASWLLPKDKNSNQNNELLLSDEYLDLADYNSNMDNKFTGQYSHHQQEGDVPQTNYVGDRVVPIQIQESNGNLRHKQQNMTYGSSDINSGSINHNNGYDTSMETDFVPEPTTPDTADGYTTDGKIDQPPEPPVKMIIQLTPMDREARVLRYREKRKTRKFEKTIRYASRKAYAERRPRINGRFAKMGETEDYDVD

SEQ ID NO: 421 - protein, 339 aa, Brassica nigra
MLKQKSNNIDSEENNRARACDTCMSTVCTVYCHADSAYLCTSCDAEVHSANRVASRHKRVPVCESCECAPAAFLCEADDASLCTACDSEVHSANAIGRRHHRVPVLPVSGNSYISMDTHHQTETTEAEPEKRLVIHQEEDEARETASWLLPKDKNSNQNNELLLSDEYLDLADYNSNMDNKFTGQYNHHQQEGDVPQTNYVGDRVVPIQIQESDGNLRHKQQNMTYGSSDINSGSINHNNGYDTSMETDFVPEPTTLDTADGDTTDGKIDQPPEPPVKMIIQLSPMDREARVLRYREKRKTKKFEKTIRYASRKAYAERRPRINGRFAKMGETEDYDVD

SEQ ID NO: 422 - protein, 339 aa, Brassica nigra
MLKQKSNNIDSEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMDTHHQTETTEAEPEKRLVIHQEEDEARETASWLLPKDKNSNQNNELLLSDEYLDLADYNSNMDNKFTGQYNHHQQEGDVPQTNYVGDRVVPIQIQESDGNLRHKQQNMTYGSSDINSGSINHNNGYDTSMETDFVPEPTTLDTADGDTTDGKIDQPPEPPVKMIIQLSPMDREARVLRYREKRKTKKFEKTIRYASRKAYAERRPRINGRFAKMGETEDYDVD

SEQ ID NO: 423 - protein, 339 aa, Brassica nigra
MLKQKSNNIDSEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMDTHHQTETTEAEPEKRLVIHQEEDEARETASWLLPKDKNSNQNNELLLSDEYLDLADYNSNMDNKFTGQYNRHQQEGDVPQTNYVGDRVVPIQIQESDGNLRHKQQNMTYGSSDINSGSINHNNGYDTSMETDFVPEPTTLDTADGDTTDGKIDQPPEPPVKMIIQLSPMDREARVLRYREKRKTKKFEKTIRYASRKAYAERRPRINGRFAKMGETEDYDVD

SEQ ID NO: 424 - protein, 343 aa, Prunus persica
MASKLCDSCKSATATLFCRADSAFLCVNCDSKIHAANKLASRHARVWLCEVCEQAPAHVTCKADDAALCVTCDRDIHSANPLSRRHERVPVTPFYDSGNSAANSAPVVKSVVNFLDDRYFSDVDGQDAETEVSREEAEAASWLLPNPKAMENPDLNSGEYFLPEMDPYLDLDYGHVDPKLEDAQEQNSCGTDGVVPVQSKSVQPQLVNDHSFEIDFSAASKPYVYGFHAQCLSQSVSSSSMDVSVVPDGNTTMTDVCDPYTKSMSAAVESTHQAVQISSADREARVLRYREKRKNRKFEKTIRYASRKAYAETRPRIKGRFAKRTEVEIEAERLCRYGVVPSF

SEQ ID NO: 425 - protein, 384 aa, Fragaria x ananassa
MLKEESNGAAAANSWARVCDTCRSAPCTVYCRADSAYLCSGCDATIHAANRVASRHERVSVCEACERAPAAFLCKADAASLCTACDADIHSANPLARRHQRVPILPISGCQIMVGSTPADTTEDGFLSQEGDEEVMDEEDEDEAASWLLLNPVKNSNNHNSNNNNPNNNNNGFLFGVEVDEYLDLVEYNSSDQNQFSGTTATNDQHNYGVPHKISYGGDSVVPVQYGEGKVTQMQMQQKHNFHQLGMEYESSKAAYGYDGSISHTVSVSSMDVGVVPDSTMSEMSVCHPRTPKGTIDLFNGPTIQMPTQLSPMDREARVLRYREKKKTRKFEKTIRYASRKAYAETRPRIKGRFAKRTDIEVEVDQMFSTSLMGETGYGIVPSY

SEQ ID NO: 426 - protein, 294 aa, Arabidopsis thaliana
MASSSRLCDSCKSTAATLFCRADAAFLCGNCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYCGFGVVPSF

SEQ ID NO: 427 - protein, 355 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVTCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 428 - protein, 323 aa, Hordeum vulgare subsp. vulgare
MEGEEKPVVGGAYWGVGARACDSCATEAARLFCRADAAFLCAGCDARAHGSGSRHARVWLCEVCEHAPAAVTCKADAAVLCASCDADIHAANPLARRHERVPVAPFFGAAADAHKPFPSSGAQAGAAASAEDDGSNDAEAASWLLPEPDHKDGANGATADVFFADSDHYLDLDFARSMDDIKAISVQLNGQPEIDLNGGNKGFYSDHSMNHSLSSSEAAVVPDAAAAPVVSRGREREARLMRYREKRKSRRFEKTIRYASRKAYAETRPRVKGRFAKRTGTADADALEEHEEMYSSAAAAVAALMAPGPDHDYGVDGVVPTLV

SEQ ID NO: 429 - protein, 498 aa, Populus trichocarpa
MEKCLNSKQKKDCFLFLPCEFCNSKAAILYCRADSAKLCLPCDQQIHSSNTLSLKHVRSQICDNCRAEPASIHCSNDNLFLCQDCDWDSHNSSFSVSSLHNRNPVEGFMGCPPVVELASLFGFDFKSDFFVDSDPGSCSFEQEAVNFQDFAVSSDDFSVLSSSGKSRQEVYKQLVEMGKRGMVRVNGDGAELGPDTPPSRCAVQWNLESLELENGDEELLHQQTPFTSLLMLPNHVDASENDCVSDLGFMWDCNYTHQGAQAWDFQLGTSLDCTIPGPQEEGYDVKDPGFMVKNYVDFTEDGAFATQKVLDDGHVTSCCSSTCEDNLSKNSCSNQQLSRYKPPTENCNNTPLLGLSPGSMPGEPNAHIQVMEQPSLTWFETLNEVRQKGDAGLFAQNRGNAMLRYDKRIRYESRKARADTRKRVKGRGKPVFLGKASPLMLWPELVVTCNPLDHINGEWSFNKHSLQKSLERSSYSDRNNASLSFASTMTVTMLHLRL

SEQ ID NO: 430 - protein, 369 aa, Populus trichocarpa
MLKQESSGGGGGDNRARVCDTCRAAPCTVYCRADSAYLCAGCDARVHAANRVASRHERVSVCEACERAPAALLCKADAASLCTACDADIHSANPLARRHQRVPILPISGCLHGSPVGPAAGETEDRFTTQEGEETISEEEEDEAASWLLLNPVKNSKNQNNNGFLFGGEVDEYLDLVEYNSCTENQCSDQYNQQHYCVPPKSYGGDRAVPIQYGEGKDHQQQRQYHNFQLGLEYEPSKAACSYNGSISQSVSMSSMDVGVVPESTMSEISISQHRPPKGTMELFSSTAIQMPSQLSPMDREARVLRYREKKKTRKFEKTIRYASRKAYAETRPRIKGRFAKRKDVEVEDDQMFSSTLMAETGYGIVPSF

SEQ ID NO: 431 - protein, 348 aa, Populus trichocarpa
MASKLCDSCKSATATLFCRADSAFLCVSCDSKIHAANKLASRHARVWVCEVCEQAPAHVTCKADAAALCVTCDRDIHSANPLAQRHERVPVTPFFDSSSAAHGGGAAVNFLEYRYLDDVNGGDDVSREEAEAESWLLPNPGGGNTKGVDSLDLNTGQYVFGAEMHPYLDLDRYVDQKVEVEVQEQNSSGTTDGVVPVQSNKLGFQAPALVNDNCCFELDFSAGSKTFAGGYGYNSLSHSVSSSSLDVGVVPDGSTLTDISNPYSRSVSNGMESANQTVQLSAVDREARVLRYREKRKNRKFEKTIRYASRKAYAETRPRIKGRFAKRTDSGVEVDRSSIYGFGVVPSF

SEQ ID NO: 432 - protein, 339 aa, Populus trichocarpa
MGIEVESLKNLTGGWSVAAKRCDSCKTAAAAAFCRADSAFLCLNCDTKIHHSGVNSKIMSRHERVWMCEVCEQAPAAVTCKADAAALCVTCDADIHSANPLARRHERVPVEPFYDSAESIVKTSSAFNFLTGDMFFCEMDPFLDFEYQNSMDGRYKQSHGGGGAGADSVVPVQNKPAPLPVIDHKNCFDIDFCRSKLTSFSSYPSQSLSHSVSSSSLDVGVVPDGNSMSDISYPFGRSMNTYTDPSMPISGSTTNQAAAQLAGIDREARVLRYREKRKNRKFEKTIRYASRKAYAETRPRIKGRFAKRTEMESDMDTLYNSPSSVPFLADTHYGVVPSF

SEQ ID NO: 433 - protein, 362 aa, Populus trichocarpa
MGIEVESLKNLTGGWSVAAKRCDSCKTAAAAAFCRADSAFLCLNCDTKIHHSQVNSKIMSRHERVWMCEVCEQAPAAVTCKADAAALCVTCDADIHSANPLARRHERVPIEPFYNSAESIVKTSTAFNILIPGENGVSGYDQNDDVEGVSWLLQSNHTTHDHNSKLQIENPVVKTGDMFFSEIDPFLELEYQNSIDASYEKIHGGAGADSVVPVQTKPAPLPVINHESCFDIDFCRSKLTSFSYSSQSLSHSVSSSSLDVGVVPDGNSIMPLSGWTANQAATQLAGIDREARVLRYRERRKNRKFEKTIRYASRKAYAETRPRIKGRFAKRTEMESDMDNLYNSPSSVPFMADTQYGVVPSF

SEQ ID NO: 434 - protein, 350 aa, Populus trichocarpa
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGEAVNLLEDRYFDEVDGGRGDVSREEAEAESWLLPNPGGGTTKGVDSMDLNTGQYVFGSEMDPYLDLDPYVDPKVEVQEQNSSGTTDGVVPVQSNKLGFQSPALVNDHCCYELDFSTGSKSFGGGYGYNSLSQSVSSSSLDVGVVPDGSGSTLTDISNPYCSRSVCNGMESANQTVQLSAVDREARVLRYREKRKNRKFEKTIRYASRKAYAETRPRIKGRFAKRTDTEVEVDRSSLYGFGVVPSF

SEQ ID NO: 435 - protein, 322 aa, Mangifera indica
MASKLCDSCKSATATLFCRADSAFLCVSCDTKIHTANKLASRHARVWVCEVCEQAPAHVTCKADAAALCVACDHDIHSANPLARRHERVPVTPFYDSVNSADKHNGVVNFFDDVEGGGDASREEAEAASWLLPNPKVVEDGPEMNTGQYVFSDMDPYLDLDYGPVDPKLEAQEQNSSGTDGVVPVQSQTAPVPLVNDHCFDLDFSGPKSFGYGYNNTQCLSHSVSSSSLDVGVVPDGSATTESTNQTVQLSSADREARVLRYREKRKNKKFEKTIRYASRKAYAEMRPRIKGRFAKRTDMDVEADRSSNSSSIYGFGVVPSY

SEQ ID NO: 436 - protein, 347 aa, Vitis vinifera
MVVEVESWRMASKLCDSCKSAPPTLFCRADSAFLCVACDSKVHAANKLASRHARVWMCEVCEQAPAHVTCKADAAALCVTCDRDIHSANPLARRHERVPVVPFYDSAAAAAKSNAVNLLVDDRYYSDPDGDASREEAEAASWLLPNPNPKLAESSDLNSSHYMFSDIDPYLDLDYPSMDPKLQSQQQQQSSGTDGVVPVQNKSVQAPLVNDNCFDMDFSGSKSFYNGQSLSQSVSSSSLEVGVVPDGNAMVDVTNPFGRSMNTGSESANQTAQISSGIDREARVLRYREKRKNRKFEKTIRYASRKAYAETRPRIKGRFAKRSEIEVDYSSSGALTADSGYGVVPSF

SEQ ID NO: 437 - protein, 394 aa, Vitis vinifera
MSDSPGDNLHHRHEEEGQKMTIQNRLCDFCGDSMALLYCRADSAKLCLSCDREVHSTNQLFTKHTRSRLCDVCDASPASILCSTDNLVLCQNCDWAKHGRSLSSAHDRRPLEGFSGQPSVTELLAFVGFEDLGKKSLFCGDESEVNEFLGCGVYESVGVDEEFSDFLVWDTPAVVNLDDLIVSTACDHNFQAMGVPPLPKNRGAPCGQHKAEIIHQLRQLAKIELSFDFDHGDAKPPIGFQSHIPKQLIQKENECNSCDHEVEFVFPTYEASAFQWCSDGSEAANQVLPSVLLGSCADEKCLVPRKHSDIGGSVSHTNGSDEGKSECPVVTKTLPALPKVSVHELNSQERDSAISRYKEKKKTRRYEKHIRYESRKARAESRIRIKGRFAKMDH

SEQ ID NO: 438 - protein, 349 aa, Vitis vinifera
MTIQNRLCDFCGDSMALLYCRADSAKLCLSCDREVHSTNQLFTKHTRSRLCDVCDASPASILCSTDNLVLCQNCDWAKHGRSLSSAHDRRPLEGFSGQPSVTELLAFVGFEDLGKKSLFYFLVWDTPAVVNLDDLIVSTACDHNFQAMGVPPLPKNRGAPCGQHKAEIIHQLRQLAKIELSFDFDHGDAKPPIGFQSHIPKQLIQKENECNSCDHEVEFVFPTYEASAFQWCSDGSEAANQVLPSVLLGSCADEKCLVPRKHSDIGGSVSHTNGSDEGKSECPVVTKTLPALPKVSVHELNSQERDSAISRYKEKKKTRRYEKHIRYESRKARAESRIRIKGRFAKMDH

SEQ ID NO: 439 - protein, 361 aa, Vitis vinifera
MGFQELNGKTFSAATWALAAKPCDSCKSAAALLFCRADSAFLCVGCDSKIHGANKLASRHERVWMCEVCEQAPASVTCKADAAALCVTCDRDIHSANPLARRHDRVPVVPFYDSAESLVKSTAAAVGFLVPGGAGDEEDSEAASWLLPNPKLPEGPEVKSGEVFFSDIDPFLDFDYPDAKFPHHHHHHCGGNDGVVPVQAKDPSPPVTNHPADNCFELDFSRSKLSAYNYTAQSLSQSISSSDVGVVPDGNCNSMSDTSYPSMKQVSGGGGGGSTGSQATQLSGMDREARVLRYREKRKNRKFEKTIRYASRKAYAETRPRIKGRFAKRTEMESEMVDHIYNSASAAAFMVDAGYGVVPSY

SEQ ID NO: 440 - protein, 339 aa, Zea mays
MDTAAELELGLELEQKPAAGYWSVVGARPCDACAAEPARLHCRADGAFLCPGCDARAHGAGSRHARVWLCEVCEHAPAVVTCRADAAALCAACDADIHSANPLARRHERLPIAPLFGALADAPQPFPSPALAAAAGAEAPAPTPAQGEAVAEDYGSSEAEAASWLLPEPDNSHEDSAADTFFAESDAYLGADLDFARCMDGVKAIGVPVAPPELDIGAGSFCYPEHSMNHILSSSSEVAVVPDAQAAGLPVVVVVSRGEEREARLMRYREKRKNRRFDKTIRYASRKAYAETRPRIKGRFAKRRSAEGEDEALEHEEGACFSPAGSAPAASDGVVPSLC

SEQ ID NO: 441 - protein, 336 aa, Sorghum bicolor
MDTAVELELEQKPAVGYWSVVGARPCDACAAEPARLHCREDGAFLCPGCDARAHGAGSRHARVWLCEVCEHAPAAVTCRADAAALCAACDADIHSANPLARRHERLPVAPFFGALADAPQPFPSPAFAAAAAAGGQAQGEAAAADNDDDDGSNEAEAASWLLAEPDNSHEDSAAATAADTLFAESDAYLGVDLDFARCMDGVKAIGVPVAPPELDIAAGSFFYPEHSMNHSLSSSEVAVVPDAQAAGVPAVVSRGKEREARLMRYREKRKNRRFDKTIRYASRKAYAETRPRIKGRFAKRCSAEADDDALEHDEGACFSPAGSAHAASDGVVPSFC

SEQ ID NO: 442 - protein, 317 aa, Allium cepa
MAVNYWGLTAKHCANCVSSPAVMYCRTDATYLCSTCEARSHSSHVRVWLCEVCEQAPAAVTCKADAATLCVTCDADIHAANPLARRHERVPVVPVGNPTVQVKEDLFGEDGEGDTWKGMMVDLNCFGGFSNELVDPYLDLDGNGDGLVPVQEKHVYGYGYRQEKGTMMPKGTVDIDFGAVGKGDGYGCGHGGYTVGVQSMSHSTTVSSSEAGVVPDNSSSMAVADVSNPYSRPLPNPMDAMDREARVMRYREKRKNRKFEKTIRYASRKAYAETRPRIKGRFAKRVDNDSYADPMHSVINASTAFMNDSGYGVVPSF

SEQ ID NO: 443 - protein, 332 aa, Ricinus communis
MASKLCDSCKSATATLFCRPDSAFLCINCDSKIHAANKLASRHARVLICEVCEQAPAHVTCKADAAALCVTCDRDIHSANPLARRHERVPITPFYDSVSSVNNKPNAVNLLDDRYFSDVDGDAADVSREEAEAASWLLPNPPNTKLVENSDPNTGQYVFSDMDPYLDLDYGPGDPKLEAQEQNSSGTDGVVPVKSSKNVQAPFVNDNCFELDFTGSKPFPYGYNAQCLSNSVSSSSLDVGVVPDGGDISNPYSKSTMESVQQLSAVDREARVLRYREKRKNRKFEKTIRYASRKAYAETRPRIKGRFAKRTDIDVEADRSSSINAFGVVPSF

SEQ ID NO: 444 - protein, 411 aa, Ricinus communis
MSDFGRTPDEQQTMMTQQHHQQERLCDYCNDTTALLYCRADSAKLCISCDREVHSTNQLFSKHTRSLLCDSCDASPASIFCETEHSVFCQNCDWEKHNLSLSSVHNRRPIEGFSGFPSVSELVSILGFEDLGDKKDKKALLFNEGDNGLASSGPDGSGFEDGYSDLLIWETPAVVSIDDLIVSSDSGPNFPALGVPPLPKAIVFRFSLFYFSCKSQNRNAVCGQHKEEILRQLRELAGLEPDPNCHNPETEPTYVFQSAAGENMQTRMTHKCCEPVARPISSPSYEENIFNWLSDNGEAGNQVSVPCTLPRSHLEESPVVPDKQSNIDGSASYANGSHEGEPQYPASTGLISVFPKVVSHDINSQERDSAISRYKEKRKTRRYDKHIRYESRKARAESRTRIRGRFAKMDR

SEQ ID NO: 445 - protein, 388 aa, Ricinus communis
MGIEMESLKSLTGGWTVAARRCDSCKTAAAAVFCRADSAFLCLNCDAKIHAANKLVSRHERVWMCEVCEQAPAAVTCKADAAALCVTCDADIHSANPLARRHERVPVEPFFDSAGSIVKSSPFNFLVPTDHNGAGSAAFNHQQHEDDDVEGVSWLLPNPSSTMINSKLGGIENHEMKSGHGGGGGSGDLFFTEMDPFLDLEFHQNNNHSSAANDSVVPVQITKPAAASSIPVMNNDICYDIDFCRTKLSSFNYPTQSLSQSVSSSSLDVGVVPDGSSTSDISYPFGRNMNTCTDPSGPISGNSTNQAAQMCGINREARVLRYREKRKNRKFEKTIRYASRKAYAETRPRIKGRFAKRTEIDTDMDRLYNSPSSVSYLGDAQYGVVPTF

SEQ ID NO: 446 - protein, 351 aa, Glycine max
MSGAEARPCDYCGNSTALLYCRADSAKLCFSCDREVHSTNQLFSKHTRTLLCDACDDSPATILCSTDTSVLCQNCDWENHNPALSDSLHERRPLEGFTGCPSVSELLSIVGFSDISKKSLLFSPQGSVADGFFGASEIEGLSDMFVWDAPSFVTLDDLISSSPSSHSFQAMKVPPLPKNRKAACGQHKEEILSQLRELAKSEPLDLEPYVQSGNLSLGFERDPEADIFPSHEWHRESSEPMHQVVPPDPSMGTYTEEIPVKHSTSAVGENHTYGDNEGKPSISLKSETLSTTPKAAACELTSQERDSALLRYKQKKKTRRFDKHIRYESRKVRAESRVRVKGRFAKMGHEH

SEQ ID NO: 447 - protein, 382 aa, Phyllostachys edulis
MNYNFGGNVYEQEVAGGEGSCPWARPCDGCNAAPSVVYCRADAAYLCASCDSRVHAANRVATRHERVRVCEACERAPAVLACRADAAVLCVSCDAQVHSANPLARRHQRVPVVPLPAAAIPAASVLAEAAAAATTVLGDKEEEVDSWLLLSKDSDNQNCSSNNNNNSMYFGEVDEYFDLVGYNSYYDNRIDNNQEQYGMQEQQQQQQQEMQKEFAEKEGSECVVPSQVAMVSEQQQQSGYVGAEQAASMTAGVSAYTDSISNSISFSSMEVGIVPDNTVIDMPNSSILTPAGAINLFSGPSLQMPLHLSTMDREARVLRYKEKKKTRKFEKTIRYATRKAYAEARPRIKGRFAKRSDVDIEVDQMFSSAALSDCSYGTVPWF

SEQ ID NO: 448 - protein, 307 aa, Vitis vinifera
MASKLCDSCKSAPPTLFCRADSAFLCVACDSKVHAANKLASRHARVWMCEVCEQAPAHVTCKADAAALCVTCDRDIHSANPLARRHERVPVVPFYDSAAAAAKSNAVNLLLAESSDLNSSHYMFSDIDPYLDLDYPSMDPKLQSQQQQQSSGTDGVVPVQNKSVQAPLVNDNCFDMDFSGSKSFYNGQSLSQSVSSSSLEVGVVPDGNAMVDVTNPFGRSMNTGSESANQTAQISSGIDREARVLRYREKRKNRKFEKTIRYASRKAYAETRPRIKGRFAKRSEIEVDYSSSGALTADSGYGVVPSF

SEQ ID NO: 449 - protein, 343 aa, Arabidopsis lyrata subsp. lyrata
MGFGLESIKSISGGWGAAARSCDACKSVTAAVFCRLDSAFLCISCDTRIHSFTRHERVWVCDVCEQAPAAVTCKADAAALCVTCDSDIHSANPLASRHERVPVESFFDSAETAVAKISPSSTFGILGSSTTVDLTAVPVMGDDLGLCPCSSEFMFADFDRLIDFEFPNSFNHPSNNDAGGDSLVPVQTKTEPLPLTNNDHCFDIDFCRSKLSAFTYPSQSVSHSVSTSSIEYGVVPDGNTNNSVSEISIPFNRSMITTSTAASTGDHQTSSMDREARVLRYREKRKNRKFEKTIRYASRKAYAESRPRIKGRFAKRTETENDDVFLSHVYASAATQYGVVPTF

SEQ ID NO: 450 - protein, 291 aa, Arabidopsis lyrata subsp. lyrata
MASSRLCDSCKSTTATLFCRADAAFLCGVCDGKIHTANKLASRHERVWLCEVCEQAPAHVTCKADAAALCVTCDRDIHSANPLSSRHERVPITPFYDTSPAKSASSSINFVDEDGGDVSASWLLHKEGIEITNLFSDLDYPKMEVTSENNSSGNDGVVPVQSKMFLNEDYFNFDLSASKISSNGFNFINQTVSRSIDVALVPESGGVTAEITNTATVTPAVQLSPAEREARVLRYREKRKNRKFEKTIRYASRKAYAEMRPRIKGRFAKRTDSRENDGGDVGVYGGFGVVP

SEQ ID NO: 451 - protein, 342 aa, Brassica rapa
MGFGLESIKPLSGGWGAAARSCDACKSASAAVYCRFDSAFLCVTCDTSIHSFTRHERVYLCEVCEQAPAAVTCKADAASLCVTCDSDIHSANPLASRHERVPVESFFDSAVAKISPSTFGVLGDSTTVDLTAVPVIGNADELGLCPWLLPNDFNEPAKIETVTELKSSEFMFSDFDRLIDFEYPNTFGADSLVPVQTKTEPLPVTNNDHCFDIDFCRSKLSTFTYPTQSISHSVSTSSLEYGVVPDGTTSVPFNRSTITTSTGTTGEQPSSMDREARVLRYREKRKNRKFEKTIRYASRKAYAESRPRIKGRFAKRTETENDDVFFSQVYASAGQYGVVPTF

SEQ ID NO: 452 - protein, 307 aa, Raphanus sativus
MASRLCDSCRSAAATLYCRADAAFLCGECDGKIHTANKLASRHERVLLCQICEQAPAHVTCEADAAALCVTCDRDIHSANPLSRRHERVSVTPFYDAPAQGGSPATTKSAASSNLFGEDADVSMEAVSWLLPNPSVKEGVVVEIPNLFADLDYSAVDPKMEASENSSGNDGVVPVQTKALFLNEDYFNFDVSASKTTFPHGYSCINQTVSSTSLEVPLVPEGGAVTTTNATPAVQLSPAEREARVLRYREKRKNRKFEKTIRYASRKAYAEVRPRIKGRFAKRTDSRVNDGGGDVGVYGGFGVVPSF

SEQ ID NO: 453 - protein, 340 aa, Malus x domestica
MALKLCDSCKSATGTLFCRADSAFLCVNCDSKIHAANKLASRHARVWLCEVCEQAPAHVTCKADDAALCVTCDRDIHSANPLSHADERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 454 - protein, 329 aa, Malus x domestica
MASKLCDSCQSATATLFCRADSAFLCVNCDSKIHAANKLASRHPRVWLCEVCEQAPAHVTCKADDAALCVTCDRDIHSANPLSSRHDRVPVTPFYDSVNSAANSVPVVKSVVNFLDDRYLSDVDGETEVSREEAEAASWLLPNPKAMENPDLNSGQYLFQEMDPYLDLDYGHVDPKLEEAQEQNSCGADGVVPVQSKNMQPLLVNDQSFELDFSAGSKPFVYGYHHARCLSQSVSSSSMDISVVPDGNAVTAAVETSQPAVQLSSVDRVARVLRYREKRKNRKFEKTIRYASRKAYAETRPRIKGRFAKRTEVEIEAERMCRYGVVPSF

SEQ ID NO: 455 - protein, 409 aa, Solanum lycopersicum
MLKKENSGGLDGSSNYWARVCDSCRSVTCTIYCQADSAYLCADCDARIHAASLVTSRHKRVWVCEACERAPAAFLCKADAASLCASCDADIHSANPLAHRHHRIPIITIPGTLYGPPAVETVGGDSMMISGSTGEGTEDDGFLSLTQDADDTIIDEEDEDEDEAASWLLLNHPVKNNNKNNVNNNNNQTNNYDMLFGGEVVDDYLDLAEYGGDSQFNDQYNVNQQQQQYFVPQMSYGGDSVVPVQDGQGKPLIFYQQQQQQQQSHHQNFQLGMEYDNSNTRLGLPASMSHSVSVVSMDVSVVPESALCETSNSQPRPQKGTIELFSGHPIQIPLLTPMDREARVLRYREKKKNRKFEKTIRYASRKAYAETRPRIKGRFAKRTDVEAEVDQMFSTQLMTDSSYRIVPSF

SEQ ID NO: 456 - protein, 312 aa, Pisum sativum
MATKLCDSCKSTKATLFCRSDSAFLCITCDSNIQAANKLASRHHRVTLCEVCEQAPAHVTCKADAAALCVSCDHDIHSANPPASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSSSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 457 - protein, 312 aa, Pisum sativum
MATKLCDSCKSTKATLFCRSDSAFLCITCDSNIHAANKLASRHHRVTLCEVCEQAPAHVTCKADAAALCVSCDHDIHSANPLASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSPSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 458 - protein, 351 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 459 - protein, 228 aa, Zea mays
MARERREIKRIESAAARQVTFSKRRRGLFKKAEELSVLCDADVALIVFSSTGKLSQFASSSMNEIIDKYSTHSKNLGKAEQPSLDLNLEHSKYANLNEQLVEASLRLRQMRGEELEGLSVEELQQLEKNLESGLHRVLQTKDQQFLEQISDLEQKSTQLAEENRQLRNQVSHIPPVGKQSVADTENVIAEDGQSSESVMTALHSGSSQDNDDGSDVSLKLGLPCVAWK

SEQ ID NO: 460 - protein, 228 aa, Zea mays
MARERREIKRIESAAARQVTFSKRRRGLFKKAEELSVLCDADVALIVFSSTGKLSQFASSSMNEIIDKYSTHSKNLGKAEQPSLDLNLEHSKYANLNEQLVEASLRLRQMRGEELEGLSVEELQQLEKNLESGLHRVLQTKDQQFLEQISDLEQKSTQLAEENRQLRNQVSHIPPVGKQSVADAENVIAEDGQSSESVMTALHSGSSQDNDDGSDVSLKLGLPCVAWK

SEQ ID NO: 461 - protein, 228 aa, Zea mays
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWK

SEQ ID NO: 462 - protein, 228 aa, Zea mays
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDSQFLEQINDLERKSTQLAEENMQLRNQVSQIPPAGKQAVADTENVIAEEGQSSESVMTALHSGSSQDNDGGSDVSLKLGLPCVAWK

SEQ ID NO: 463 - protein, 228 aa, Lolium perenne
MARERREIKRIESAAARQVTFSKRRRGLFKKAEELSVLCDADVALIVFSSTGKLSQFASSSMNEIIDKYSTHSKNLGKADQPSLDLNLEHSKYANLNDQLAEASLRLRQMRGEGLEGLTVDELQQLEKNLETGLHRVLQTKDQQFLEQINELQRKSSQLAEENMQLRNQVSQIPIAGKPVVADTENVIAEDGQSSESVMTALHSGSSQDNDDGSDVSLKLGLPCSAWK

SEQ ID NO: 464 - protein, 228 aa, Triticum aestivum
MARERREIKRIESAAARQVTFSKRRRGLFKKAEELSVLCDADVALIVFSSTGKLSQFASSSTNEIIDKYSTHSKNLGKTDQPALDLNLEHSKYANLNDQLAEASLRLRQMRGEELEGLSVDELQQLEKNLETGLHRVLQTKDQQFLEQINELHRKSSQLAEENMKLRNQVGQIPTAGKLVVADTENVVAEDGQSSESVMTALHSGSSQDNDDGSDVSLKLGLPCLPWK

SEQ ID NO: 465 - protein, 228 aa, Triticum aestivum
MARERREIKRIESAAARQVTFSKRRRGLFKKAEELSVLCDADVALIVFSSTGKLSQFASSSMNEIIDKYSTHSKNLGKTDQPALDLNLEHSKYANLNDQLAEASLRLRQMRGEELEGLSVDELQLLEKNLETGLHRVLQTKDQQFLEQINELHRKSSQLAEENMKLRNQVGQIPTAGKLVVADTENVVAEDGQSSESVMTALHSGSSQDNDDGSDVSLKLGLPCLPWK

SEQ ID NO: 466 - protein, 228 aa, Triticum aestivum
MARERREIKRIESAAARQVTFPKRRRGLFKKAEELSVLCDADVALIVFSSTGKLSQFASSSMNEIIDKYSTHSKNLGKTDRPALDLNLEHSKYANLNDQLAEASLRLRQMRGEELEGLSVDELQQLEKNLETGLHRVLQTKDQQFLEQINELHRKSSQLAEENMKLRNQVGQIPTAGKLVVADTENVVAEDGQSSESVMTALHSGSSQDNDDGSDVSLKLGLPCLPWK

SEQ ID NO: 467 - protein, 225 aa, Hordeum vulgare subsp. vulgare
MARERREIKRIESAAARQVTFSKRRRGLFKKAEELSVLCDADVALIVFSSTGKLSQFASSSMNEIIDKYSTHSKNLGKTDQPTLDLNLEHSKYANLNDQLAEASLRLRQMRGEELEGLSVDELQQLEKNLETGLHKVLQTKDQQFLEQINELHRKSSQLAEENKKLRNQVAQVPTAGKLVVVDTENVIAEDGQSSESVMTALHSGSSQDNDDGSDVSLKLALPWK

SEQ ID NO: 468 - protein, 229 aa, Oryza sativa Indica Group
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEEGQSSESVMTALHSGSSQSQDNDDGSDVSLKLGLPCGAWK

SEQ ID NO: 469 - protein, 228 aa, Oryza sativa Japonica Group
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEGQSSESVMTALHSGSSQSQDNDDGSDVSLKLGLPCGAWK

SEQ ID NO: 470 - protein, 223 aa, Oryza sativa Japonica Group
MARERREIRRIESAAARQVTFSKRRRGLFKKAEELAVLCDADVALVVFSSTGKLSQFASSNMNEIIDKYTTHSKNLGKTDKQPSIDLNLEHSKCSSLNEQLAEASLQLRQMRGEELEGLSVEELQQMEKNLEAGLQRVLCTKDQQFMQEISELQRKGIQLAEENMRLRDQMPQVPTAGLAVPDTENVLTEDGQSSESVMTALNSGSSQDNDDGSDISLKLGLP

SEQ ID NO: 471 - protein, 226 aa, Festuca arundinacea
MARERREIRRIESAAARQVTFSKRRRGLFKKAEELGVLCDADVALVVFSSTGKLSQFGSSSMDEIIDKYSTHSKNLGKSQEKPALDLNVEHSKYNSLNEQLAEASLHLRHMRGEELAGLSVGELQQMEKDLETGLQRVLCTKDQQFMQQISDLQQKGTQLAEENMRLRNQMPQVPTAGMMAVADTENVVTEDVLSSESVMTAVHSGSSQDNDDGSDISLKLALPWK

SEQ ID NO: 472 - protein, 226 aa, Triticum aestivum
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQKVLCTKDRQFMQQISDLQQKGTQLAEENMRLKNQMHEVPTVSTVAVAEAENVVPEDAHSSDSVMTAVHSGSSQDNDDGSDISLKLALPWK

SEQ ID NO: 473 - protein, 226 aa, Triticum aestivum
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQRVLCTKDRQFMQQISDLQQKGTQLAEENMRLKNQMHEVPTASTVAVAEAENVVPEDAHSSDSVMTAVHSGSSQDNDDGSDISLKLALPWK

SEQ ID NO: 474 - protein, 226 aa, Triticum aestivum
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQRVLCTKDRQFMQQISDLQHKGTQLAEENMRLKNQMHEVPTASTVAVAEAENVVPEDAHSSDSVMTAVHSGSSQDNDDGSDISLKLALPWK

SEQ ID NO: 475 - protein, 221 aa, Oryza sativa Indica Group
MARERREIRRIESAAARQVTFSKRRRGLFKKAEELAVLCDADVALVVFSSTGKLSQFASSNMNEIIDKYTTHSKNLGKTDKQPSIDLNLEHSKCSSLNEQLAEASLQLRQMRGEELEGLSVEELQQMEKNLEAGLQRVLCTKDQQFMQEISELQRKGIQLAEENMRLRDQMPQVPTAGLAVPDTENVLTEDGQSSESVMTALNSGSSQDNDDGSDISLKLG

SEQ ID NO: 476 - protein, 228 aa, Triticum aestivum
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRRMRGEELDGLSVGELQQMEKNLETGLQRVLCTKDRQFMQQINDLQQKGTQLAEENMRLKNQMHEVPTASMVAVADADAENVVPDDVHSSDSVMTAVHSASSQDNDDGSDISLKLALPWK

SEQ ID NO: 477 - protein, 245 aa, Oryza sativa Japonica Group
MARERREIRRIESAAARQVTFSKRRRGLFKKAEELAVLCDADVALVVFSSTGKLSQFASSNMNEIIDKYTTHSKNLGKTDKQPSIDLNFFLIILLRTYTNSYAYIHLLLQLEHSKCSSLNEQLAEASLQLRQMRGEELEGLSVEELQQMEKNLEAGLQRVLCTKDQQFMQEISELQRKGIQLAEENMRLRDQMPQVPTAGLAVPDTENVLTEDGQSSESVMTALNSGSSQDNDDGSDISLKLGLP

SEQ ID NO: 478 - protein, 223 aa, Hordeum vulgare subsp. vulgare
MARERRAIRRIESAAARQVTFSKRRRGLFKKAEELAVLCDADVALVVFSSTGKLSQFASSSMNEIIDKYSTHSKNLGKSDQQPAIDLNLEHCKYDSLNEQLAEASLRLRHMRGEELDGLSVGELQQMEKNLETGLQRVLCTKDRQFMQQISDLQQKGTQLAEENMRLKNQMHEVPTASMVAVADVVPEDVHSSDSVMTAVHSASSQDNDDGSDISLKLALPWK

SEQ ID NO: 479 - protein, 219 aa, Lolium perenne
MARERREIRRIESAAARQVTFSKRRRGLFKKAEELGVLCDADVALVVFSATGKLSQFASSSMDEIIDKYSAHSKNLGKSQEKPALDLNVEHSKYNSLNEKLAEASLHLRHMRGEELGGLSVGELQQMEKDLETGLQRVLCTKDQQFMQQISDLQQKGTQLAEENMRLRNQMPQVPTAGMMAITEDVLSSESVMTAVHSGSSQDNDDGSDISLKLALPWK

SEQ ID NO: 480 - protein, 225 aa, Sorghum bicolor
MARERREIRRIENAAARQVTYSKRRRGLFKKAEELAVLCDADVALVVFSATGKLSQFASTSMNHIIDKYSTHSKNLGKSHQQSPIDLNIEQSKYTGLNEQLAEATHGLRQMRGENLEGLSVEELHQMERKLEAGLHRVLSTKDQLFTQQISELQQKGTQLEDENRRLKEQMPQVLTAGTMVVGAGAENILTEDGQSSESVMTALHSGSSLDNDDGSDICLKLSLP

SEQ ID NO: 481 - protein, 225 aa, Zea mays
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQMPQVLTAGTMVVAAAAENILTEDGQSSESVMTALHSGSSLDCDDGSDISLKLSLP

SEQ ID NO: 482 - protein, 225 aa, Zea mays
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQMPQVLTGGTMVVAAAAENILTEDGQSSESVMTALHSGSSLDCDDGSDISLKLSLP

SEQ ID NO: 483 - protein, 183 aa, Zea mays
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQKISSLKTGSRLNL

SEQ ID NO: 484 - DNA, 3912 bp, Arabidopsis thaliana
acaccaataaaaatacacagcaataaaatcgctacgtatatatatatataatatgtattatctattacaagatagtaatagagtatagcaagttgtatcatctaacaaactatgcgaataaaatttgaacattgtgacatgtagatgtagtgtaatttagctaagtgcttatcatcagtaacatagaccgacttaactttttacgaaaaaaaaaaagtaacatagaccgaaaaaatgcatatcgtaaatttaatggaaaacacaatttacgataagtaaaaaacaaaaagaaattacgataagtcgagaaaaatgcaacaaattgagataaagtattgataaaaccatgaaagtgtcggcgtatgtaaatgcggtgattaatgtgatcattagagcgtgtgtgttaaacgcggcggttttagtggagattgatcagctgataacactcttaccgggacgaatctaattccatattcatggcttgttaaaacctaagacatacgcaatctctaatttgctagtatagttagttctatattatttttcgactaataatgtaaacatatgattattaagtcgcaaaaagagtgcttaacaaccaaaaagtggattaattaacttggtgggaaaagttacaaaacctttaatgattactctttgtaccaagaatagtggcgaagcactataagagcagagaaaagaagctcaataatgtactaaaagttgtagatttttacagcttaaatacaccaaaattaatagaaaagttggtaattttttaattcatggctactgatttagattttagaaaacaatagtagtatcattgtcacatcttaaacacacaataggtatgttttaaatcaaaggccgtagttaatttgtcaaaaatgtatgcatttggtatttggatgtctccgaaaggatggatatatggacttgttagataatttcatacctcagtatcaatagtcatggagcccaaattgctcaaaaacatatttttaattccaagactttgatgaagacgtaataatgagtccaatgggccatcagatacaatgttcggaatttaacgggtttgttagttataagtattgggcttgacctatctggttcaatgatatgtaggaacaacccaatttgcaaagctttattaaaagactctttagttgtcgtcaaggtttaacttgtagtagttggtaagaaattctacgtgaaataggcaacattacaaaaacaaaaatcaattcgaaatcatacaaaacgaaaccaagtagtaaccaactacactattatgacattaatgattagacattcccaaatcatacaagttcctgtcatgaaggaaacaatggtccgtatttgcaaacgattacaaaaattcaaaccaaaaatgaaaaaacgagttaaattatttggtttataaaaatagtaatgtcaacagaagactagattgggaaacctgaagcgaacagagcttttaaaaacgagtttgaacggctgggatcatttggtacaatacccaccgtaagtttgtttaccctagggatgcaagccaaaggcccaaatcagttactacttactgctacaaccatcgtctcagctttttgtctcagctttttactaatgaagcatacaatttcttgggcatgtcacatctcgacacgtgtccactattctcttctcttattggctactcgttcgtaggcttctgttaatagatgatctctctataactctaacagtcttttctttctctttatttcgttttggtattttaagtttcaaattgaaaataataggaggaaaagtctagttttaaatattgtttttttacaagtgaacgtgaaccaatttacctctttttttttatatatcctatcggctaatctggttagtatcggtagaaatgcaccgaggtgctacagagattaatgctagggatagtcagaccgcttgtatttctgactatcaagtaaatctacgcccaactcacatatttcccaaacaaatgtgattttttttttttttttttttttttttttttttttgtaacaaatgtgattttgttttcaaggaaaatagaacttacgtttgggaatttcacccttcactaaagcttccttctgccattagaccacaaaggcttgggcaatttaccatttttgtaaaagtagaaaacaaaatgcctaaaatgttcatacttcattacatcaacaaggttatgcccacgatatagaggcatgtaacatttatatatatagtggaagaagcctacgagctttattaataagtataaactctgattattaggtaaataaattacttaaaacgattactcaactgacaaaaccgtagttgaataataaggttactatgaataccgattgaatattgcaaagccggaattgaaaaatatataacagatcaaatgttcaagtgtggtcataattctcacataggtcatatagctgaacccatgcatctatttactagtctatagaaagtactagagacgcatacagctgaacctactctattcttttattaattttggttctcgtggatacaaaattcctccaacatttattagaacgaataaaaccaatatgatgatgattagttattggtaaacatataaacgttgagtaaacttcaaaatagattgaagtactattaagacttgcattttttccccttgggttatattcttgaatcgtttcgaagtattttaactttcaagaatagaaggttcctcaactataaacaattacattaatcaaaaccatttctatgtaaacaacataatttttgtatattttagtcttccccaaaagtttgaccgatagggcggtttagaccgtatagtacgactgtacaacaaaaaggactctggagacctaaagatccaaaactatgcaaaataaagatacggtcggaccaatttaatctaacaaaaccaaatccttatactaaactatttaccgatacatttccatataacacagtacacacaattaaatcaaacattattggaagaacaagatagaatattggcttaatctcgaacgattagagttatcctagagcctcggagcttttgtcacatataatataaactatggtatatataaacatgactctcatttgtatttatcgcaaggtacaattccaccaatttttttcgtcccactcatacagctttaattgtgaaatcaatccataaaaaaccaacatgtgacatggtctctataactataactataagatagtaaaaaattcacatcaacataaaagaaaaccaatcatattggctaaaaaaaactaacggtcgaaaaacgtataaccacaaaaccaaaccggtccaaccggtgtccccaatcactatcaaagcattaactaactttcacaaggaaaagcatagttcagtttctctacatcgcttcccatcctcttaaccctgtttactcgaatcatccaccgttggatcaaacacgcgctacaaatctagcgcgtgaccgaggtttttacacagtggaatattaccatgcattggaaagcggcgtctacaacaaacggcgggtcatgtcaccgtcaaaatcaacctttcttaattcctaacgccgttacttatctccgtttactaaaaatgttaatgcgtgtgagagtgaagatcatatactaattagaagtggctaatgttttaacgtgacattattatcatagttaatggttcgatcagagttttaagtagtaaatgatataagtgtgtgtatataattgcatacatatatactctcacactctgacagatttgtcgtggtcttagtattctctttcatggctagttatatagggctctagtacattatctctctctccccatttctctgtctctctcttctttaa

SEQ ID NO: 485 - DNA, 363 bp, Zea mays
catacaaattatatatatatattttaaatatcaaatctttataagaatgatgatccactgtccactgctgcccacttcccacgcccaaaacaagttcacctccgtggcgcgtgttccgaaaagtcctcttgttgtgggcgggagaatggaggcgtaatatttcggcgtccccgaaatttgcttgcaccttattggccgagccacccctcccacggatcgtgccctgctggcaacattgcagccatcggtgcccctctagatccaaccatccactgtcctcgcacgcggatccacgggcccaccagcctcggcagccgagttgtttaaactttataaatacccgtcgccgcctgctactttccc

SEQ ID NO: 486 - DNA, 246 bp, Zea mays
gtggcctgggaaaagagagagcccaaccaaggcggcccatctgcgacgcttcggcactgtcaagcatcccgcacaggcgcagcaccgcagtcatcggtgacatttgtcgctacagctgtttcaggcatctgccacctcggtcacatgccgtccgccacgtcgagaccgcgagctccctacgtgtcacgcccagccatgcccgacgtctccggtgccgtgttttaaagaacgcgccgtagcgcactg

SEQ ID NO: 487 - DNA, 1456 bp, Zea mays
tgtttggactccagaaaatttacgggagttggtggagcaggtcattaagtactataaaaaatcatgtagctgaagctgcaagtatttagaagacatttagataagttattttatttatcatttagattaagaaaatttaaaactatttaaattgatattataaactacagctccacactggagctagatcctggagtcattacaaacacccccttaatgggaaaagagaagataatgtatatctaattattgtttctgtgtcacctatagctattagttcaaaacttcataatcactggtacaaataagctctagagaggcggttcggaacccatttttattgttgtttttcaaaaccactagtgttagggaccgccagtggaaactgaaacgccattggaaattgattttcactgatggtgagctaagaaaaccgccattggtaatcctttgcagaaaacataaactaggttttaaaaatagtaaacaaatatttttattaggagaggccccacatagtcgcaccatttttcgcgcattattcacgcgctacgcaaccaatggtaattgaacctcagagacttcactcttgtgtagcctcctttgccactccactaaacacttacttgtgtcttgattgcattttgttgcccacatattagaacaaacagagtgtaaattgattgtttgaggctgtaaacaaattcaaatgaaaaagtagtcaactactaaattgaataattgtttatgttctaccacttttattttggtacttttcccatcggaggcggtttgtaaaatttgcattttaagttttacaaatttcaatgaaattttgagagcccaaatgatttcaaataaaaaagttgtcaactacaatgttttataacttttaatttggtggttttttaaacaagctcatttgaaaaactaaaatgatcgattctacatgatttttaggtcgattttttaaggaatcgcctgtacaaatatttctactgacagtttttaagaaaccacctgtggaaatcatagatttgtactagcggtttttctcaagtaactgctagtagaaatatggtggttttcttaagaaaactgtttgtaggaatgcacgatttatataaatggatttgttaagaaaaccgctagtggaatgttctttcaactaacggttattgagtcgtgacagccaatttaatttccttgataactaaaagcggctgtaaaaattagaccatgatgtaggcacggagctgttttgtactgaatgcgcccactgttttgttggaaaagtgcatgtacttattattcattctgtttatttctagctggcattcagttcttacagccacagattatgcaaaacgcctatttctgccagcaaatttacaggaaaagtcatggacttttccgggttattttcctataagtacagccattcctttcacttaca

SEQ ID NO: 488 - DNA, 710 bp, Zea mays
ttcagcgttatttgaacaccgtaaagcctctccagcagattgtgaatacacagttgtggagaacgctatttataacgcagacactatttataatgcagatgtgtaaaagtgaaatttaaaatagtagatgagataggagagatagaatgagtaaactgctggagagcaaatcgtgcatatgatcgtgcaaaacaccgtttttcgtagagtgaagtttaaaatagcaggtgagagagtagataggatgagtaagctgatggagagcaaatattgtatatacgtggtcggtgcaatagagtgaaatttgaaataactgacacagttttggtgcgtggaaatagacgaggataattctagtgcaatccgcactgccagtggaccccgcccgacgataattctacgcacgggcggcgcactgcactactagttcatcgatcggatgcgttagcgtgcccctcctcatattgtttccttgtacgtactagtgcaatccgtcagccgcacggctccagtccactccagtccagcaacagcgtcacctccagctccgaaaggcttatccttgcaacaaacatcgtacgaaaaaggcgcaggaaaaagaaaagtgtcgaaatacgacataaaaaaagcatcaaaatacgctgcgagtgagcgagacattggcctccccatcccatatatatatagctatagctatccctcggttcttc

SEQ ID NO: 489 - DNA, 1718 bp, Zea mays
atctctcctctcctctcctctcctcccgttggtgtgactgtagtagatcctttgcccgtgtcagaacaagctgctcctcggaccgggtaatgttaaacatcggaggagcctttgcctaggatccgtaacggggaggaaagagaaaaaaaactaaggatgattatggataccgtgtaataactgctaactacagttagcccatctcagcggactctctgccctatattgtatgtcactttctattataaactacactatacaacctatgatgtaaaataatgttttgcacgttcatatataaatcagtcgaagaaagggtgcctcactacagggaatggtttctattggacaccttagcattcaatcagtcatgtccccccccccccccaaaaaaaaaatgcacccatccagtcgatttttgtcatatttgaattcggtggtgctccatgcacgcgtacctgctttgaccaatttatacgatcaatatataacttacgttcttacggttcttagactttatgagactttgcaagtatgtttggatacaaatcacactaatgtgcatctttgtaaactaaattcttttgattaaatttgtaattttaaggtttaacctgtttttgttgtgtagacgacgttaggcaccgatcgtcgcttcgctatatatctttgttgtagacgacgttagactcctagattaaataagcgaaaaccgatcgtcgcttcgctatctttgtttatttgtttgtggctgctctacgctgaagagcccacaggccacagccccacacgacacgttaggcacccccacccaccatccgcgcataatataagctactgcaaaatatatgccggcggagcccgagcgagctttgtacttgctccgccgtggcctggctccaggatgctttggatttcgtgcggcgccgtacgtccaggcaaacagacaagtggagctgcatgtcctaaaagcccggcaatcaaacacgctctagcagcagcatggatcacagatatcagtcatggggtggcgctggcgcgggtgggtggccaggtggaggtgggtgcatgtcgtcgtcgtcgtcccatacagaaattggctcacgtatgtatacgctgcgtacaggcagtagtacacaattactagcaccaatgcaatccaacggatggatcttcgcacacccgccacccggttaaattaagctactcctacctctcccagtctcccttggcctgcctctatatttttgggcagcctccaccagccgggcggatggggttggatcgtcgtatctgaggcggcgtggtcgtccaaggcgaaagcaacggcgcagggctgggaccctagtaggtgcatgaggtcgtgcatggcgcgcgagatgcatggtttgggttaggcctaggaggttctctctccatggcatgggtagctcgcgccgcttggctgccgttctcgtgtatgcgcatgcaccaggcatttgcaccgcgccgtgtatatttctggcgtgggggccggcgccgcattggagctgcagccccgtttcggcacggacacgggacacctcccgttagggtaagcccggggcagtgggtaactgcccagcgccactactccgaatttaccctccttttatttttaaagcttgggagaggggagaatggatggatggatggatgtagacgcgtgaaaaagatgcgcgagaccggcagcgtgtgct

SEQ ID NO: 490 - DNA, 51 bp, Arabidopsis thaliana
tatatcatcgttctctctataaactttatagaactttgttctgattttctc

SEQ ID NO: 491 - DNA, 997 bp, Zea mays
gctgcttccggtagcctgaagcagaaaaaaactgaaagaaacatgacagataattccctcggagaaacttggcatgtttcccgttggtcatgtaggacgacgataatgataaattggtaagcaaagaaaaaggctactaagctcgagcagtagaagctacctagctcgtcgtaacgaagaaacttctcgtccttcaggtagacccttgcttgtttgcagtactttagttagggttcggtctttaattcttttgctgggcagcagtaaacggagatgagaagcgcgagctgatcattgttgccattctgtgcaacgaagctaggggaccaatgctgactcgcacgagggcatagttgctgatggtcatagacgacgcgttcacttaaaataataaagaattataaattgttgtcataagtcgtgcagcctaatataggagagtgcggcattgctgtagctaattaagagagtattccggtcatgcttgagcttggagaatttttgagggtccgttcgcttggagagtcggagatttttgagggcccgttcgcttgcacaataataaacaaagatttgttctagctcatccaaatctatataaattaaagaagtaattcggttaggaatcaatccagagctctaattcttaaaaaccgaacagggcctgagttgtttgtctagacgacattatctgattaagttattttcatcttcaatttcaaatgtgatctagcggcataaaacttgttgtctgacagatatttgacttccacacgggccacagctcaattacaaacatacttcaaacatcaggcagaggcagagcactagcagcattcgctacgtggcggtgggcagcagtggccagcacattcgacaactgccacggatcccgtactacttcaaacacgtatcgcttccagaatccagagtcacacgtgtgcagctgcatgaacccagctcactcccttaagaacagctcgacgctcacctgtct

The invention claimed is:

1. A modified corn plant or a plant part thereof comprising 1) a first recombinant expression cassette comprising a transcribable DNA sequence encoding a non-coding RNA for suppression of one or more gibberellic acid 20 (GA20) oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, 2) a second recombinant expression cassette comprising a first DNA sequence encoding a CONSTANS-like (COL) polypeptide that has at least 95% sequence identity to the amino acid sequence as set forth in SEQ ID NO: 168, and 3) a third recombinant expression cassette comprising a second DNA sequence encoding a MADS-box polypeptide that has at least 95% sequence identity to the amino acid sequence as set forth in SEQ ID NO: 176; wherein the modified corn plant is semi-dwarf and has one or more improved ear traits, relative to a control corn plant that does not have the first, second and third recombinant expression cassettes.

2. The modified corn plant or plant part thereof of claim 1, wherein the first, second and third recombinant expression cassettes are stably integrated into the genome of the corn plant or plant part thereof.

3. The modified corn plant or plant part thereof of claim 1, wherein the transcribable DNA sequence comprises a sequence that is at least 90% identical or complementary to at least 15 consecutive nucleotides of SEQ ID NO: 39, 53, or 55.

4. The modified corn plant or plant part thereof claim 1, wherein the first DNA sequence of the second recombinant expression cassette comprises a sequence that is at least 90% identical to SEQ ID NO: 169.

5. The modified corn plant or plant part thereof of claim 1, wherein the second DNA sequence of the third recombinant expression cassette comprises a sequence that is at least 90% identical to SEQ ID NO: 177.

6. The modified corn plant or plant part thereof of claim 1, wherein the expression level of an endogenous GA20 oxidase gene is reduced or eliminated in the modified corn plant or plant part thereof.

7. The modified corn plant or plant part thereof of claim 1, wherein the transcribable DNA sequence encoding the non-coding RNA for suppression of the one or more GA20 oxidase genes is operably linked to a heterologous plant-expressible promoter.

8. The modified corn plant or plant part thereof of claim 7, wherein the heterologous plant-expressible promoter:
  i. is a vascular promoter;
  ii. is selected from the group consisting of a sucrose synthase promoter, a sucrose transporter promoter, a Sh1 promoter, *Commelina* yellow mottle virus (CoYMV) promoter, a wheat dwarf geminivirus (WDV) large intergenic region (LIR) promoter, a maize streak geminivirus (MSV) coat polypeptide (CP) promoter, a rice yellow stripe 1 (YS1)-like promoter, a rice yellow stripe 2 (OsYSL2) promoter, and a combination thereof;
  iii. comprises a DNA sequence that is at least 95% identical to one or more of SEQ ID NO: 67, SEQ ID NO: 68, SEQ ID NO: 69, SEQ ID NO: 70 or SEQ ID NO: 71;
  iv. is a rice tungro bacilliform virus (RTBV) promoter; or
  v. comprises a DNA sequence that is at least 95% identical to one or more of SEQ ID NO: 65 or SEQ ID NO: 66.

9. A seed of the modified corn plant of claim 1, wherein the seed comprises the first, second, and third recombinant expression cassettes.

10. The seed of claim 9, wherein a progeny plant grown from the seed is semi-dwarf and has one or more improved ear traits, relative to a control corn plant that does not comprise the first, second, and third recombinant expression cassettes.

11. A commodity or commodity product produced from the seed of claim 9, comprising the first, second, and third recombinant expression cassettes.

12. A method comprising planting the seed of claim 9 in a growth medium or soil.

13. A plurality of modified corn plants in a field, each modified corn plant comprising the modified corn plant of claim 1.

14. A method for producing a modified corn plant, the method comprising a method selected from the group consisting of (1)-(17):

(1) a. introducing into a corn cell a first recombinant expression cassette comprising a coding sequence for a COL polypeptide that has at least 95% sequence identity to the amino acid sequence as set forth in SEQ ID NO: 168, wherein the corn cell comprises a second recombinant expression cassette comprising a transcribable DNA sequence encoding a non-coding RNA for suppression of one or more GA20 oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, and a third recombinant expression cassette comprising a coding sequence for a MADS-box polypeptide that has at least 95% sequence identity to the amino acid sequence as set forth in SEQ ID NO: 176; and b. regenerating or developing a modified corn plant from the corn cell, wherein the modified corn plant comprises the first, second and third recombinant expression cassettes; and wherein the modified corn plant is semi-dwarf and has one or more improved ear traits, relative to a control corn plant that does not have the first, second and third recombinant expression cassettes;

(2) a. introducing into a corn cell a first recombinant expression cassette comprising a coding sequence for a MADS-box polypeptide that has at least 95% sequence identity to the amino acid sequence as set forth in SEQ ID NO: 176, wherein the corn cell comprises a second recombinant expression cassette comprising a transcribable DNA sequence encoding a non-coding RNA for suppression of one or more GA20 oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, and a third recombinant expression cassette comprising a coding sequence for a COL polypeptide that has at least 95% sequence identity to the amino acid sequence as set forth in SEQ ID NO: 168; and b. regenerating or developing a modified corn plant from the corn cell, wherein the modified corn plant comprises the first, second, and third recombinant expression cassettes; and wherein the modified corn plant is semi-dwarf and has one or more improved ear traits, relative to a control corn plant that does not have the first, second and third recombinant expression cassettes;

(3) a. introducing into a corn cell a first recombinant expression cassette comprising a transcribable DNA sequence encoding a non-coding RNA for suppression of one or more GA20 oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, wherein the corn cell comprises a second recombinant expression cassette comprising a coding sequence for a MADS-box polypeptide that has at least 95% sequence identity to the amino acid sequence as set forth in SEQ ID NO: 176 and a third recombinant expression cassette comprising a coding sequence for a COL polypeptide that has at least 95% sequence identity to the amino acid sequence as set forth in SEQ ID NO: 168; and b. regenerating or developing a modified corn plant from the corn cell, wherein the modified corn plant comprises the first, second, and third recombinant expression cassettes; and wherein the modified corn plant is semi-dwarf and has one or more improved ear traits, relative to a control corn plant that does not have the first, second and third recombinant expression cassette;

(4) a. introducing into a corn cell 1) a first recombinant expression cassette comprising a transcribable DNA sequence encoding a non-coding RNA for suppression of one or more GA20 oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, 2) a second recombinant expression cassette comprising a coding sequence for a COL polypeptide that has at least 95% sequence identity to the amino acid sequence as set forth in SEQ ID NO: 168, and 3) a third recombinant expression cassette comprising a coding sequence for a MADS-box polypeptide that has at least 95% sequence identity to the amino acid sequence as set forth in SEQ ID NO: 176; and b. regenerating or developing a modified corn plant from the corn cell, wherein the modified corn plant comprises the first, second, and third recombinant expression cassettes; and wherein the modified corn plant is semi-dwarf and has one or more improved ear traits, relative to a control corn plant that does not have the first, second and third recombinant expression cassettes;

(5) a. crossing a first modified corn plant with a second modified corn plant, wherein the first modified corn plant comprises a first recombinant expression cassette comprising a transcribable DNA sequence encoding a non-coding RNA for suppression of one or more gibberellic acid 20 (GA20) oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, wherein the expression or activity of one or more endogenous GA20 oxidase genes is reduced in the first modified corn plant relative to a wildtype control, and wherein the second modified corn plant comprises a second recombinant expression cassette comprising a coding sequence for a COL polypeptide that has at least 95% sequence identity to the amino acid sequence as set forth in SEQ ID NO: 168 and a third recombinant expression cassette comprising a coding sequence for a MADS-box polypeptide that has at least 95% sequence identity to the amino acid sequence as set forth in SEQ ID NO: 176; and b. producing a progeny corn plant comprising the first, second, and third recombinant expression cassettes and has the reduced expression of the one or more endogenous GA20 oxidase genes; wherein the progeny corn plant is semi-dwarf and has one or more improved ear traits, relative to a control corn plant that does not have the first, second and third recombinant expression cassettes;

(6) a. crossing a first modified corn plant with a second modified corn plant, wherein the first modified corn plant comprises a first recombinant expression cassette comprising a coding sequence for a COL polypeptide that has at least 95% sequence identity to the amino acid sequence as set forth in SEQ ID NO: 168, wherein the second modified corn plant comprises a second recombinant expression cassette comprising a transcribable DNA sequence encoding a non-coding RNA for suppression of one or more gibberellic acid 20 (GA20) oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, wherein the expression or activity of one or more endogenous GA20 oxidase genes is reduced in the second modified corn plant relative to a wildtype control, and wherein the second modified corn plant comprises a third recombinant expression cassette comprising a coding sequence for a MADS-box polypeptide that has at least 95% sequence identity to the amino acid sequence as set forth in SEQ ID NO: 176; and b. producing a progeny corn plant comprising the first, second, and third recombinant expression cassettes and has the reduced expression of the one or more endogenous GA20 oxidase genes; wherein the progeny corn plant is semi-dwarf and has one or more improved ear traits, relative to a control corn plant that does not have the first, second and third recombinant expression cassettes;

(7) a. crossing a first modified corn plant with a second modified corn plant, wherein the first modified corn plant comprises a first recombinant expression cassette comprising a coding sequence for a MADS-box polypeptide that has at least 95% sequence identity to the amino acid sequence as set forth in SEQ ID NO: 176, wherein the second modified corn plant comprises a second recombinant expression cassette comprising a transcribable DNA sequence encoding a non-coding RNA for suppression of one or more gibberellic acid 20 (GA20) oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, wherein the expression or activity of one or more endogenous GA20 oxidase genes is reduced in the second modified corn plant relative to a wildtype control, and wherein the second modified corn plant comprises a third recombinant expression cassette comprising a coding sequence for a COL polypeptide that has at least 95% sequence identity to the amino acid sequence as set forth in SEQ ID NO: 168; and b. producing a progeny corn plant comprising the first, second, and third recombinant expression cassettes and has the reduced expression of the one or more endogenous GA20 oxidase genes; wherein the progeny corn plant is semi-dwarf and has one or more improved ear traits, relative to a control corn plant that does not have the first, second and third recombinant expression cassettes;

(8) a. performing one or more crossings using one or more modified corn plants, wherein the one or more modified corn plants are selected from the group consisting of:
  i. a modified corn plant comprising a first recombinant expression cassette comprising a transcribable DNA sequence encoding a non-coding RNA for suppression of one or more gibberellic acid 20 (GA20) oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, wherein the expression or activity of one or more endogenous GA20 oxidase genes is reduced in the modified corn plant relative to a wildtype control,
  ii. a modified corn plant comprising a second recombinant expression cassette comprising a coding sequence for a COL polypeptide that has at least 95% sequence identity to the amino acid sequence as set forth in SEQ ID NO: 168, iii. a modified corn plant comprising a third recombinant expression cassette comprising a coding sequence for a MADS-box polypeptide that has at least 95% sequence identity to the amino acid sequence as set forth in SEQ ID NO: 176, iv. a modified corn plant comprising a first recombinant expression cassette comprising a transcribable DNA sequence encoding a non-coding RNA for suppression of one or more gibberellic acid 20 (GA20) oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, wherein the expression or activity of one or more endogenous GA20 oxidase genes is reduced in the modified corn plant relative to a wildtype control, and comprises a second recombinant expression cassette comprising a coding sequence for a COL polypeptide that has at least 95% sequence identity to the amino acid sequence as set forth in SEQ ID NO: 168, v. a modified corn plant comprising a first recombinant expression cassette comprising a transcribable DNA sequence encoding a non-coding RNA for suppression of one or more gibberellic acid 20 (GA20) oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, wherein the expression or activity of one or more endogenous GA20 oxidase genes is reduced in the modified corn plant relative to a wildtype control, and comprises a third recombinant expression cassette comprising a coding sequence for a MADS-box polypeptide that has at least 95% sequence identity to the amino acid sequence as set forth in SEQ ID NO: 176, and vi. a modified corn plant comprising a second recombinant expression cassette comprising a coding sequence for a COL polypeptide that has at least 95% sequence identity to the amino acid sequence as set forth in SEQ ID NO: 168 and a third recombinant expression cassette comprising a coding sequence for a MADS-box polypeptide that has at least 95% sequence identity to the amino acid sequence as set forth in SEQ ID NO: 176, and b. producing a progeny corn plant comprising the first, second, and third recombinant expression cassettes and has the reduced expression of the one or more endogenous GA20 oxidase genes; wherein the progeny corn plant is semi-dwarf and has one or more improved ear traits, relative to a control corn plant that does not have the first, second and third recombinant expression cassettes;

(9) a. introducing into a corn cell a first recombinant expression cassette comprising a coding sequence for a COL polypeptide that has at least 95% sequence identity to the amino acid sequence as set forth in SEQ ID NO: 168 operably linked to a first plant-expressible promoter, and wherein the corn cell comprises (1) one or more mutations and/or edits in one or more endogenous GA20 oxidase genes and (2) a second recombinant expression cassette comprising a coding sequence for a MADS-box polypeptide that has at least 95% sequence identity to the amino acid sequence as set forth in SEQ ID NO: 176 operably linked to a second plant-expressible promoter; and b. regenerating or developing a modified corn plant from the corn cell, wherein the modified corn plant comprises the first and second recombinant expression cassettes and the one or more mutations and/or edits, and wherein the level of expression or activity of the one or more endogenous GA20 oxidase genes in the modified corn plant is reduced relative to a control plant not having the one or more mutations and/or edits;

(10) a. introducing into a corn cell a first recombinant expression cassette comprising a coding sequence for a MADS-box polypeptide that has at least 95% sequence identity to the amino acid sequence as set forth in SEQ ID NO: 176 operably linked to a first plant-expressible promoter, and wherein the corn cell comprises (1) one or more mutations and/or edits in one or more endogenous GA20 oxidase genes and (2) a second recombinant expression cassette comprising a coding sequence for a COL polypeptide that has at least 95% sequence identity to the amino acid sequence as set forth in SEQ ID NO: 168 operably linked to a second plant-expressible promoter; and b. regenerating or developing a modified corn plant from the corn cell, wherein the modified corn plant comprises the first and second recombinant expression cassettes and the one or more mutations and/or edits, and wherein the level of expression or activity of the one or more endogenous GA20 oxidase genes in the modified corn plant is reduced relative to a control plant not having the one or more mutations and/or edits;

(11) a. mutating or editing one or more endogenous GA20 oxidase genes in a corn cell, wherein the corn cell comprises (1) a first recombinant expression cassette comprising a encoding sequence for a COL polypeptide that has at least 95% sequence identity to the amino acid sequence as set forth in SEQ ID NO: 168 operably linked to a first plant-expressible promoter and (2) a second recombinant expression cassette comprising a encoding sequence for a MADS-box polypeptide that has at least 95% sequence identity to the amino acid sequence as set forth in SEQ ID NO: 176 operably linked to a second plant-expressible promoter; and b. regenerating or developing a modified corn plant from the corn cell, wherein the modified corn plant comprises the first and second recombinant expression cassettes and the one or more mutations and/or edits, and wherein the level of expression or activity of the one or more endogenous GA20 oxidase genes in the modified corn plant is reduced relative to a control plant not having the one or more mutations and/or edits;

(12) a. introducing into a corn cell a first recombinant expression cassette comprising a coding sequence for a COL polypeptide that has at least 95% sequence identity to the amino acid sequence as set forth in SEQ ID NO: 168, wherein the corn cell comprises a second recombinant expression cassette comprising a coding sequence for a MADS-box polypeptide that has at least 95% sequence identity to the amino acid sequence as set forth in SEQ ID NO: 176; and b. regenerating or developing a modified corn plant from the corn cell, wherein the modified corn plant comprises the first and second recombinant expression cassettes;

(13) a. introducing into a corn cell a first recombinant expression cassette comprising a coding sequence for a MADS-box polypeptide that has at least 95% sequence identity to the amino acid sequence as set forth in SEQ ID NO: 176, wherein the corn cell comprises a second recombinant expression cassette comprising a coding sequence for a COL polypeptide that has at least 95% sequence identity to the amino acid sequence as set forth in SEQ ID NO: 168; and b. regenerating or developing a modified corn plant from the corn cell, wherein the modified corn plant comprises the first and second recombinant expression cassettes; wherein the modified corn plant has one or more improved ear traits, relative to a control corn plant that does not have the first and second recombinant expression cassettes;

(14) a. introducing into a corn cell 1) a first recombinant expression cassette comprising a coding sequence for a COL polypeptide that has at least 95% sequence identity to the amino acid sequence as set forth in SEQ ID NO: 168, and 2) a second recombinant expression cassette comprising a coding sequence for a MADS-box polypeptide that has at least 95% sequence identity to the amino acid sequence as set forth in SEQ ID NO: 176; and b. regenerating or developing a modified corn plant from the corn cell, wherein the modified corn plant comprises the first and second recombinant expression cassettes; wherein the modified corn plant has one or more improved ear traits, relative to a control corn plant that does not have the first and second recombinant expression cassettes;

(15) a. crossing a first modified corn plant with a second modified corn plant, wherein the first modified corn plant comprises a first recombinant expression cassette comprising a coding sequence for a COL polypeptide that has at least 95% sequence identity to the amino acid sequence as set forth in SEQ ID NO: 168, and wherein the second modified corn plant comprises a second recombinant expression cassette comprising a coding sequence for a MADS-box polypeptide has at least 95% sequence identity to the amino acid sequence as set forth in SEQ ID NO: 176; and b. producing a progeny corn plant comprising the first and second recombinant expression cassettes; wherein the progeny corn plant has one or more improved ear traits, relative to a control corn plant that does not have the first and second recombinant expression cassettes;

(16) a. introducing into a corn cell a first recombinant expression cassette comprising a coding sequence for a COL polypeptide that has at least 95% sequence identity to the amino acid sequence as set forth in SEQ ID NO: 168 operably linked to a first plant-expressible promoter, and wherein the corn cell comprises a second recombinant expression cassette comprising a coding sequence for a MADS-box polypeptide that has at least 95% sequence identity to the amino acid sequence as set forth in SEQ ID NO: 176 operably linked to a second plant-expressible promoter; and b. regenerating or developing a modified corn plant from the corn cell, wherein the modified corn plant comprises the first and second recombinant expression cassettes; wherein the modified corn plant has one or more improved ear traits, relative to a control corn plant that does not have the first and second recombinant expression cassettes; and

(17) a. introducing into a corn cell a first recombinant expression cassette comprising a coding sequence for a MADS-box polypeptide that has at least 95% sequence identity to the amino acid sequence as set forth in SEQ ID NO: 176 operably linked to a first plant-expressible promoter, and wherein the corn cell comprises a second recombinant expression cassette comprising a coding sequence for a COL polypeptide that has at least 95% sequence identity to the amino acid sequence as set forth in SEQ ID NO: 168 operably linked to a second plant-expressible promoter; and b. regenerating or developing a modified corn plant from the corn cell, wherein the modified corn plant comprises the first and second recombinant expression cassettes;

wherein the modified corn plant has one or more improved ear traits, relative to a control corn plant that does not have the first and second recombinant expression cassettes.

15. A modified corn plant comprising 1) one or more mutations or edits at or near one or more endogenous GA20 oxidase genes, wherein the expression or activity of the one or more endogenous GA20 oxidase genes is reduced relative to a wildtype control plant, 2) a first recombinant expression cassette comprising a coding sequence for a COL polypeptide that has at least 95% sequence identity to the amino acid sequence as set forth in SEQ ID NO: 168 operably linked to a first plant-expressible promoter, and 3) a second recombinant expression cassette comprising a coding sequence for a MADS-box polypeptide that has at least 95% sequence identity to the amino acid sequence as set forth in SEQ ID NO: 176 operably linked to a second plant-expressible promoter.

16. A plurality of modified corn plants in a field, each modified corn plant comprising the modified corn plan of claim 15.

17. A recombinant DNA construct comprising:
a. 1) a first recombinant expression cassette comprising a transcribable DNA sequence encoding a non-coding RNA for suppression of one or more GA20 oxidase genes, wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15, and wherein the transcribable DNA sequence is operably linked to a first plant-expressible promoter, 2) a second recombinant expression cassette comprising a coding sequence for a COL polypeptide that has at least 95% sequence identity to the amino acid sequence as set forth in SEQ ID NO: 168 operably linked to a second plant-expressible promoter, and 3) a third recombinant expression cassette comprising a coding sequence for a MADS-box polypeptide that has at least 95% sequence identity to the amino acid sequence as set forth in SEQ ID NO: 176 operably linked to a third plant-expressible promoter; or b. a first recombinant expression cassette comprising a coding sequence for a COL polypeptide that has at least 95% sequence identity to the amino acid sequence as set forth in SEQ ID NO: 168 operably linked to a first plant-expressible promoter, and a second recombinant expression cassette comprising a coding sequence for a MADS-box polypeptide that has at least 95% sequence identity to the amino acid sequence as set forth in SEQ ID NO: 176 operably linked to a second plant-expressible promoter.

18. A modified corn plant or a plant part thereof comprising 1) a first recombinant expression cassette comprising a first DNA sequence encoding a CONSTANS-like (COL) polypeptide that has at least 95% sequence identity to the amino acid sequence as set forth in SEQ ID NO: 168, and 2) a second recombinant expression cassette comprising a second DNA sequence encoding a MADS-box polypeptide that has at least 95% sequence identity to the amino acid sequence as set forth in SEQ ID NO: 176; wherein the modified corn plant has one or more improved ear traits, relative to a control corn plant that does not have the first and second recombinant expression cassettes.

19. A seed of the modified corn plant of claim 18, wherein the seed comprises the first and second recombinant expression cassettes.

20. A commodity or commodity product produced from claim 19, comprising the first and second recombinant expression cassettes.

21. A method comprising planting the seed of claim 19 in a growth medium or soil.

22. A plurality of modified corn plants in a field, each modified corn plant comprising the modified corn plant of claim 18.

23. The modified corn plant of claim 18, wherein the first DNA sequence encoding the COL polypeptide is operably linked to a first plant-expressible promoter, and the second DNA sequence encoding the MADS-box polypeptide is operably linked to a second plant-expressible promoter.

24. A plurality of modified corn plants in a field, each modified corn plant comprising the corn plant of claim 23.

25. A transformation vector comprising the recombinant DNA construct of claim 17.

26. A modified corn plant or a plant part thereof comprising the recombinant DNA construct of claim 17.

* * * * *